United States Patent 10,676,751 (PRODUCTION AND USE OF PLANT DEGRADING MATERIALS) - sequence listing, part 2

SEQ ID NO: 1930 - DNA, 1145 bp, Aspergillus pseudotamarii
ggatcgatttgcaaggacggatgggtcgacaactgcggcttgtaacactgaggatcgggtctgctgtcccctattagttttcaacaagaggaatgtaaaactgactcagtatagaaatactgtggtggaacatggcagggcatcatcgataaggtaaaccgctcactcaatcaaaagaagaagaagaaaaaaaaaagaattctggtcctaaccatcacttagctggattatatccaaggaatgggcttcacagccatctggatcacccccgttacaggccagctgccccagaacaccgcatacggagacgcctaccatggttactggcagcaggatatgtaagtcacctactagtaccatcttacgcataaatatgaactaacttgaagagcttagatactctttgaacgaaaattacggcacagcagatgacttgaaggctctctcttcggcccttcatgagaggggaatgtatctgatggtcgatgtggttgctaaccatatagttcgtggtcctctttgattgactttgcacgcatggtttatttcaatactgacaatgagtaaaatcagggctatgatggagcgggagcctcagttgattacagcgtgttcaagccgttcaattcccaagaatacttccacccattctgtctcattcaaaactatgaggaccagacccaggttgaggattgctggttaggagataatactgtttctctgcccgatctcgataccactaaagatgaggttaagaatgagtggtacgactgggtgggaacattagtatcaaactactccagtaagatcttttaccctcattctctaactttgaatgatcgatgacacttacgaaatcagttgatggcctccgtatcgacaccgtgaagcacgtccagaaggacttctggccggggtacaacaaagccgcaggcgtgtactgcatcggcgaagtccttgacggtgatccggcgtacacatgcccctaccaggacgtcatggatggcgtactgaattacccaatgtataacacccttaaccataagccttcttgtcgtttcatccgctaacgagatgttcaaaaccagttactacccactcctcaacgccttcaaatcaacctccggcagcatggacgacctcta

SEQ ID NO: 1931 - DNA, 1178 bp, Aspergillus parasiticus
ggatcgatttgcaaggacggatgggtcgacgactgcaacttgtaatactggggatcgggtgtgttgttacctactagctttcagcaagaggaatgtaacctgacttgatatagaaatactgtggtggaacatggcagggcatcatcgacaaggtaaattgcccctttatcaaaaaaagaaaaaaaaaaaaaaaaaggcagaagaaaaataaaataaaaagaactctggtcctaactatcacatagttggattatatccagggaatgggcttcacagccatctggatcacccccgttacagcccagctgccccagaccaccgcatatggagatgcctaccatggctactggcagcaggatatgtaagtcgatttctttaagcacctacctgtcatcttttacatcaagatggcctaactcgatggtcttagatactctctgaacgaaaactacggcactgcagatgacttgaaggcgctctcttcggcccttcatgagagggggatgtatcttatggtcgatgtggttgctaaccatatggttcgtggtcctttgcaactgacttcacaggtatagttcatttcagtactgacagtgagtaatatcagggctatgatggagcgggtagctcagtcgattacagtgtgtttaaaccgttcagttcccaagactacttccactcgttctgtctcattcaagactatgaggatcagacccaggttgagaattgctggctaggagataacactgtctccttgcctgatcttgataccaccaaggatgaggtcaaaaatgaatggtacgactgggtgggaacattggtatcgaactactccagtaagacctattacgctcattctctaacttaattgatcgataatactgacgagatcagttgacggtctccgtattgacacggtgaaacacgtccagaaggacttctggccggggtacaacaaagccgcaggcgtgtactgtatcggcgaagtgctcgacggtgatccggcctacacatgtccctaccaggacgtcatggatggcgtactgaactatcccatgtatgacttccccaaccatgagccttcttgcagtcccatcctctaacaaaacggctaaaaccagttactacccactcctcaacgccttcaagtcaacctccggcagcatggacgacctcta

SEQ ID NO: 1932 - DNA, 1175 bp, Aspergillus SP.BN8
ggatcgatttgcaaggacggatgggtcgacgactgcggcttgtaatactgcggatcgggtgtgttgttacctactagctttcagcaagaggaatgtaaactgacttgatatagaaatactgtggtggaacatggcagggcatcatcgacaaggtaaattgcccctttatcaaaaaaaagaaaaaaaagcagaagaaaaataaaataaaaagaactctagtcctaaccatcacatagttggactatatccagggaatgggcttcacagccatctggatcacccccgttacagcccagctgccccagaccaccgcatatggagatgcctaccatggctactggcagcaggatatgtaagtcgatttctttaagcacctacctgtcatcttttacatcaatatgaactaacttgatggttttagatactctctcaacgaaaactacggcacagcagatgacttaaaggcgctctcttcagcccttcatgagagggggatgtatcttatggtcgatgtggttgctaaccatatgggtcgtggtcctttacaaattgacttcgcaggtatggtcatttccagtactgacaaggagtaaattagggctatgatggagcgggaaggtcagtcgattacagtgtgtttaaacccgttcagttccccaggattacttcccactcgtttctgtctcatccaaaactatgaggatcagacccaggttgaggattgctggctaggagataacactgtctccttgcctgatctcgataccaccaaggatgtggtcaagaatgaatggtacgactgggtgggatccattggtatggaactactccagtaagatcttcccccctcattctacaacttgactgatcgatgatacttacgaaatcagttgacggcctccgtatcgacacagtaaaacacgtccagaaggacttctggccggggtacaacaaagccgcaggcgtgtactgtatcggcgaggtgctcgacggtgatccggcctacacatgtccctaccagaacgtcatggacggtgtactgaactatcccatgtatggttcctccaaccaggagccttcttgcagtctcatcttctaacgaaacggctaaaaccagttactacccactcctcaacgccttcaagtcaaacctccggcagcatggacgacctcta

SEQ ID NO: 1933 - DNA, 1171 bp, Aspergillus flavus
ggatcgatttgcaagggacgggatgggtcgacgactgcgacttgtaatactgcagatcgggtgtgttgttacctactatctttcagcaagaggaatgtaaactgacttgatatagaaatactgtggtggaacatggcagggcatcatcgacaaggtaaattgcccctttatcaaaaaaagatgaaaaagcagaagaaaaataaaataagaactctagtcctaaccatcacatagttggactatatccagggaatgggcttcacagccatctggatcacccccgttacagcccagctgccccagaacaccgcatatggagatgcctaccatggctactggcagcaggatatgtgagtcgatttctttaagtacctacctgtcatcttttacatcaatatgaactaacttgatggttttagctactctctgaacgaaaattacggcactgcagatgacttgaaggcgctctcttcggcccttcatgagagggggatgtatcttatggtcgatgtggttgctaaccatatggttcgtggtcctttgcaactgacttcgcggatatggttccatttccagtactgaccaatggagtaatatcagggttatgatggagcgggtagctcagtcgattacagtgtgtttaaaccgttcagttcccaagactacttccacccgttctgtctcattcaaaactatgaggatcaggctcaggttgaggattgctggctaggagataacactgtctccttgcctgatctcgataccaccaaggatgtggtcaagaatgaatggtacgactgggtgggatcattggtatcgaactactccagtaagatatttctccctcattctacaacttggctgatcgatgatacttacggaatcagttgacggcctccgtatcgacacagtaaaacacgtccagaaggacttctggcccgggtacaacaaagccgcaggcgtgtactgcatcggcgaggtgctcgacggtgatccggcctacacttgtccctaccagaacgtcatggacggcgtactgaactatcccatgtatgattcctccaaccatgagccttcttgcagtctcatctcctaacaaaacggctaaaaccagttactacccactcctcaacgccttcaagtcaacctccggcagcatggacgacctcta

SEQ ID NO: 1934 - DNA, 1180 bp, Aspergillus clavatus
ggatcgatttgcaagggacggatgggtcgacgactgcgacttgtaatactgcggatcgggtgtgttgttacctactagccttcagaaagaggaatgtaaactgacttgatatagaaatactgtggtggaacatggcagggcatcatcgacaaggtaaattgcccctttatcaaaaaaaaaaaaaaaaagaaggaaaagcagaagaaaaataaaataaaaagaactctagtcctaaccatcacatagttggactatatccagggaatgggcttcacagccatctggatcacccccgttacagcccagctgccccagaccaccgcatatggagatgcctaccatggctactggcagcaggatatgtaagtcgatttctttaaatatctacctgtcatcttttacatcaatatgaactaacttgatgggtttagatactctctgaacgaaaactacggcactgcagatgacttgaaggcgctctcttcggcccttcatgagagggggatgtatcttatggtcgatgtggttgctaaccatatgggtcgtggtcctttgcaactgacttcccggatatgggttcatttcagtactgacaatgagtaatatcagggctatgatggagcgggtagctcagtcgattacagtgtgtttaaaccgttcagttcccaagactacttccacccgttctgtctcattcaaaactatgaagatcagactcaggttgaggattgctggctaggagataacactgtctccttgcctgatctcgataccaccaaggatgtggtcaagaatgaatggtacgactgggtgggatcattggtatcgaactactccagtaagatatttccccctcattctacaacttggctgatcgatgatacttacgaaatcagttgacggcctccgtatcgacacagtaaaacacgtccagaaggacttctggcccgggtacaacaaagccgcaggcgtgtactgcatcggcgaagtccttgacggtgatccggcctacacatgtccctaccagaacgtcatggacggcgtactgaactatcccatgtatgattcctccaaccatgagccttcttgcagtctcatctcctaacaaaacggctaaaaccagttactacccactcctcaacgccttcaagtcaacctccggcagcatggacgacctcta

SEQ ID NO: 1935 - DNA, 1800 bp, Aspergillus clavatus
atggacaatgagaatacgcgcgggtatgatacagcagacggctgtgccggggatgcagacgctctggataagttacgctggtggcagaaggcaagcatatatcaggtgttgattcagagcttccaagacagtgatggcgatggtaagggggacattcgaggattagtcgatcgtctcgattattttgtcgcactcggtgttgatgttgtctgggtgtctcccatctatgagtcgccaatgcaggacatggggtatgatataagcaactatcgaaaagtcaatccgatctttggaaccatggaagatttggagctgttgataaatgaaacacatgacagaggactgaaattgatcctcgacattgctttgaaccacacagctacagagcatgaatggtttcaaacgtcaagacgagcccgcaaagatcccagcctagggaagagagattggtatttctggagcgaggggaagcgagatgagtctggcaaccgtatacctccaaacaactgggagagcacgttcactggatcgacatgggagcttgacgaagtggcggacgagttctacctgcatatatttggaaagaaccagcctgacctcaactgggattgcgaggaagtgcgaaaggaattgtacagtgtgttgaggttctggctggacaaaggagtggatggatttcgactcgacacgatgaatctagtctcaaagacatcatcgttcccagatgcccccatcgccaagccaggatctatatggcagcctgctaatcatctatttgcaaacggcccccatatccatgaatacttacaggagatgtacgaagaggtcctttctcactacgactgtatgaccttggcagagatgtcgtgcggcgtctcccccgctgaagcggttcggtatacttcacagttcaactctcggccagagctaaatttgatcattcaattccagcatgtggaactcgactgccatgacggcgataagtggatgctgagagagtgggagctcccggaactgaaacgaatcatcaacgaatggcaggaaacattgatcgacaatggcggctggaacacagtatggatggagaatcatgatcagccaagaggcatttcgaggttcacgacaaatagtccgcggttccgggctttatgtgccaagatgcttgcgctatggcagttcacgctgcaaggcaccaatctgatcttccagggacaggagttggggatgatcaacccgggactattctcggaagaactgaaccgtgatatcgaaacagtccaatattggcgaacgtcaggaagtgaggcgccacagaagcttgagctggccaagaaggcaatcatacaaaagggtcgggataacactcggatccctattccatggactgaagatccccatggggggtttacagcgccaacagccgagccatggttgccaggtttcgatcacggtcgagaatggtgccatgctattcaacaacacagtcccgagtcagtgtggacattctaccgctccgtgatccatatgcgaaagtcaaacccgacactgtactgcggatcatatgaatgcctggacgtagaaaaccccatcatttgggcttacaagcgacgatccaagcacaagtgttacctggttgttctcaatttctgcggatgcgcctcgtcctggaactatgcgaatcacggtgtggacttgacgacatccaggttactgatatcgaaccatatgaccagcgaagcaagctctaccccggatcttattttcctgaggccttttgaaggtcgtttgtaccaattataa

SEQ ID NO: 1936 - protein, 599 aa, Aspergillus clavatus
MDNENTRGYDTADGCAGDADALDKLRWWQKASIYQVLIQSFQDSDGDGKGDIRGLVDRLDYFVALGVDVVWVSPIYESPMQDMGYDISNYRKVNPIFGTMEDLELLINETHDRGLKLILDIALNHTATEHEWFQTSRRARKDPSLGKRDWYFWSEGKRDESGNRIPPNNWESTFTGSTWELDEVADEFYLHIFGKNQPDLNWDCEEVRKELYSVLRFWLDKGVDGFRLDTMNLVSKTSSFPDAPIAKPGSIWQPANHLFANGPHIHEYLQEMYEEVLSHYDCMTLAEMSCGVSPAEAVRYTSQFNSRPELNLIIQFQHVELDCHDGDKWMLREWELPELKRIINEWQETLIDNGGWNTVWMENHDQPRGISRFTTNSPRFRALCAKMLALWQFTLQGTNLIFQGQELGMINPGLFSEELNRDIETVQYWRTSGSEAPQKLELAKKAIIQKGRDNTRIPIPWTEDPHGGFTAPTAEPWLPGFDHGREWCHAIQQHSPESVWTFYRSVIHMRKSNPTLYCGSYECLDVENPIIWAYKRRSKHKCYLVVLNFCGCASSWNYANHGVDLTTSRLLISNHMTSEASSTPDLIFLRPFEGRLYQL

SEQ ID NO: 1937 - DNA, 1827 bp, Aspergillus clavatus
atgccatcacaaggtgcagtcatgccgggcgagacacgaaacaagtccgtgacgcagtccggcgcctataaaccgtacattctcgatatggatcgagaatggtggcgggaaattatcatctatgagatctatgtgcagtcctttcaggatagcaataacgatggtatcggtgatctacgcggcatcattcagcggctggattacctgaaggatctcggtgtagacatggtctggttgactcctatttatgcatcaccccttgaagaccagggttatgatattgcaaactacaaggcaatcaatcctattttcggcactatggaggactgggacgagctttgcgaagagctccacaagagaggtatgaaaatgatgatggacatggtgttcaaccacaccagctctcagcatgcatggttcctggagtcaaagaaaagcaaggataacccgaagcgtaactggtatttctggagaaaagggaagactggcaaacacggggagcgcttgcctccgaacaattgggagagtttattcggaggtcctgcctggaaatatgatgagtctactgacgaatggtacatgcacttgttctccccatctcagccagacttgaactgggacaacccggaagtgcgagacgccatttacgacgtgattgacttctggggcagtaagggaacagatggattccgttttgatgttatcaatcttgtctccaagacacctggtcttccagatgcacccatcacaagaccggataaatttgagcagccagctgttccaatgtttaccaatggcccaaatatccacatatacatgcacgagatgaaccgaaaggtcctgagcaagtacaccaactgcacagttggtgagatgccctgcggcgtagacgaatatgagtcaagccagtatgtagccaaggagcgccaggagctttctatggtcttccagtttcatcacatggatctggatggggaggggggcgataagtgggatcctcgtccatgggaactctgggagcttgagaaggtattcagaatctggcagcaacatatgcttggtaacaatggttggaattctctttatatggagaatcatgatcaagcccgggccgtgtcgcgattcggcaaccccgatccacgttacagggcagtgtctgcaaagatgctagccacaatactgctgagcctcaggggaaccccgttcctctatcaaggacaggaactgggcacgcctcatccgcagaactggaagattgaacactatgatgacgttgagacgcatgaatattacaaagctcagtataaagcacgcaagaagatggatcccttgagagagcccgatatgtccgacgtgatgtatgtcatccgtctgaaaggccgtgataatgcacgcacacccatgttgtgggataatacgcctaacggaggcttttgtccccctgaggtgaagccgtggctacggatgaacgaagaatacgccgatttcaatgtcgagactcagacgagagatcccgactcggtcttgaattatttcaagaagctgatccatatccgcagacaacacccgctgatgtcttacggagcttatatccccatcaacccaactgatccaaaggtgttctcgttcctacgaacacaggggccatggcgcagcctggtcttttgcaactggtcggcggatccttcttgcttcgagatccccgaggaaatcgacatcgacctagccgtgatgctggtcgccaactacgaagtgaaggaatgggttcttcctcggaacgtcaacctgagggcatatgagactcgggtttactcactccgtaactaa

SEQ ID NO: 1938 - protein, 608 aa, Aspergillus clavatus
MPSQGAVMPGETRNKSVTQSGAYKPYILDMDREWWREIIIYEIYVQSFQDSNNDGIGDLRGIIQRLDYLKDLGVDMVWLTPIYASPLEDQGYDIANYKAINPIFGTMEDWDELCEELHKRGMKMMMDMVFNHTSSQHAWFLESKKSKDNPKRNWYFWRKGKTGKHGERLPPNNWESLFGGPAWKYDESTDEWYMHLFSPSQPDLNWDNPEVRDAIYDVIDFWGSKGTDGFRFDVINLVSKTPGLPDAPITRPDKFEQPAVPMFTNGPNIHIYMHEMNRKVLSKYTNCTVGEMPCGVDEYESSQYVAKERQELSMVFQFHHMDLDGEGGDKWDPRPWELWELEKVFRIWQQHMLGNNGWNSLYMENHDQARAVSRFGNPDPRYRAVSAKMLATILLSLRGTPFLYQGQELGTPHPQNWKIEHYDDVETHEYYKAQYKARKKMDPLREPDMSDVMYVIRLKGRDNARTPMLWDNTPNGGFCPPEVKPWLRMNEEYADFNVETQTRDPDSVLNYFKKLIHIRRQHPLMSYGAYIPINPTDPKVFSFLRTQGPWRSLVFCNWSADPSCFEIPEEIDIDLAVMLVANYEVKEWVLPRNVNLRAYETRVYSLRN

SEQ ID NO: 1939 - DNA, 1899 bp, Neosartorya fischeri
atgaagtggatctcaccgctcctcccgctgtccctgtccttgtgcctgctcggacaggctgcccatgctctgaccccagccgaatggcgcagtcaatcaatctatttcctcctgaccgatcggtttggccgagaagacaattccacaactgctgcctgcgatgtcacgcaaagactgtattgcggtggtagctggcaggggatcatcaatcatctcgactacattcaaggaatgggatttactgctatatggatcaccccagtaactcagcagttctatgagaacaccggcgatggtacttcctaccatgggtactggcagcagaatatctacgaggtcaattccaactatggaacggcacaagatcttagaaagctggccgacgctctgcacgcgcgtggcatgtacttgatggtcgatgtggtcgccaaccatatgggctacgacggagcgggaaactcggtagactacagtgtcttcactccgtttgattcctctacctacttccacacatactgtctcatctccgactacaacaaccagaataatgtagaggactgctggctgggagacaccactgtctcactgcccgatcttgacacgaccaacacggcagtgcgaaccatctggtatgattgggtgaagggattggttgccaactactccatcgacggcctgcgcatcgacactgtgaagcatgtcgagaaagacttctggcccgactacaatgacgctgctggcgtctactgtgtcggcgaggtcttttcgggtgatccctcctatacctgtccataccagaattacatggatggtgtactcaactatccaatatactatcaacttctctacgcgtttcaatcgaccagcggcagcatcagcaatctctacaacatgatcagctccgttgactctgactgtgcggatcccaccttgctcggcaactttatcgagaaccatgataacccccgatttgcctcctatacgagcgactattcgcaagccaagaatgtcatctccttcatgttcttctccgatgggatccccattgtctacgcaggacaggaacagcattacagcggcggcgctgacccggccaatcgcgaggctgtctggctgtctggatactcgaccagcgccacgctgtacagctggatcgcctctaccaacaagatccgcaagctagcgatctccaaagactcagcctacataacatccaagaacaacccgttctactatgattccaacaccctcgctatgcgcaagggttcagtcgctggctctcaagtcatcaccgttctcagtaacaagggatcctcgggcagttcctacaccctctccctcagcggcacgggctactccgccggcgccacccttgtcgagatgtatacgtgcactactctaaccgtggactcgagcggaaacctcgccgtgccaatggcatccggtttgccccgggttcttgtgccctcgtcatgggtcagtggaagtggcctctgcggtgattctatctccaccatcgcgacaaccaccaccagtaccaccaagaccacgacagtggcgacaacgacagcatgcgcatctgccacagcccttccgattctcttcgaggaactcgtcacaactacctacggagagaccatctacctgaccggctcgatcagccaactcggcaactgggacactagttctgcgatcgccctgtcggcaagtaaatacacctcgtcgaaccctgaatggtatgccacggtgaccttgcctgttggcacctcatttcagtacaaattcttcaagaaggaatcggatgggagcatcgtgtgggagagtgatccgaaccggtcgtatacggtgccggctgggtgtgcgggaacgaccgtgacggtgtctgatacgtggagatga

SEQ ID NO: 1940 - protein, 632 aa, Neosartorya fischeri
MKWISPLLPLSLSLCLLGQAAHALTPAEWRSQSIYFLLTDRFGREDNSTTAACDVTQRLYCGGSWQGIINHLDYIQGMGFTAIWITPVTQQFYENTGDGTSYHGYWQQNIYEVNSNYGTAQDLRKLADALHARGMYLMVDVVANHMGYDGAGNSVDYSVFTPFDSSTYFHTYCLISDYNNQNNVEDCWLGDTTVSLPDLDTTNTAVRTIWYDWVKGLVANYSIDGLRIDTVKHVEKDFWPDYNDAAGVYCVGEVFSGDPSYTCPYQNYMDGVLNYPIYYQLLYAFQSTSGSISNLYNMISSVDSDCADPTLLGNFIENHDNPRFASYTSDYSQAKNVISFMFFSDGIPIVYAGQEQHYSGGADPANREAVWLSGYSTSATLYSWIASTNKIRKLAISKDSAYITSKNNPFYYDSNTLAMRKGSVAGSQVITVLSNKGSSGSSYTLSLSGTGYSAGATLVEMYTCTTLTVDSSGNLAVPMASGLPRVLVPSSWVSGSGLCGDSISTIATTTTSTTKTTTVATTTACASATALPILFEELVTTTYGETIYLTGSISQLGNWDTSSAIALSASKYTSSNPEWYATVTLPVGTSFQYKFFKKESDGSIVWESDPNRSYTVPAGCAGTTVTVSDTWR

SEQ ID NO: 1941 - DNA, 6560 bp, OPHIOSTMA FLOCCOSUM
ccgattcttcaagagacagccagtggacgggcggacagagcttgtttacgtatgtattctttgcaggttgacaactcccaggtgcggggataacccgagcggctgccggctctcagaggatgccagagtaacatttgccgttgcgttgtgtttggctgtcgttgcggtggctcttgtggcaggggttatgctctggtatccccgtcggacgcgcaggctgcccctgtcactcctctagtgcaaaggagatgtctggttcacatgctattttctcttctcccttggccgtcacattgtggtccagcctttattcagaatatgcataaaatcataattcgcacgtcaaaataagtagaaaaacgactatacatctaaaatagaataatcggccgcgagtagggggggaaaaaaaaacgttagtcacggttctagatcaaaacgtaaagcaatgagaatgaccataagcatgacgggcttctttctttcgggccttccatggacgatctagagacgccacggcctggcgactgcagatgtataatatgagaggggcgacgcggagaatatagtctgtttggggacgggggccgataggttgtgaagttgaaaatgccatgatgcggggaacaggcggtggccagcaacggcagtagaaacaaacaaacaaataaaaacagaaagaaaaaaaaaatcacaatatctatatgacgcacgacatgggacaaggacactgcaattggaacagaatgaagacgggacgaacatacgtgtgtgagcgggtgaggggccgggggtggcccgatgcgagacgaaatccgagaacaccgaagctgtaatgacaaaacggcagaatatattacgtatgcagtggaaatgaaaaaggaagacgaagggggaaagaagaatgaaaataaataaaaaatagtgaaatatagtacaaagtccccggccatatcacgtccacccggcgtcaccccggcgccgaaaacacggaggtggagggtcgcaatgcagggggagtccaggaacaggataaagcagaaggacaatgaatggtaaagggcatcatggggttggctgtccagccatatagttcacgcacttcgcgttccgtcgtattccgtgcctgacaggccttgtatgccccatgatcaacatgcccgtttctgtgtgtttctgtgagggttgcgttcggaccgccctcggctgttctgacaacctagcttggtgacagcaagatcggcatttacactgcataactgtttttacctaggaggtcatccggggtgaagtggaactagacaggccacacggcacactccgtacttcgagagcttgaagagcagtgccactagactgtgttaataacatggcccgctgttaatacagaaaagagaaaccactaagctatatagaagagcagatatgaccagggcatagcaggaattaagaagtcgacaggccgtggatgacgtgtatagctactccgaagtcgcatttagagtccaacccagataccgaatatgatctggacaagcaggtgatagatacacagagaccgtcgtagtttggagagcatgagagcagcatcgtgaggtcaacgccagcccaagacgcagccctgtcaagaccatgtcgtgcttgtgcagaatacagccgagactaaggtcttttgcatgcagatcttccatagacaagtatttttttttcttcttttttttcttcttttcttcttctttttttcttgcagcttgtcactgatgacgctgctttcgatggatgaaagctatggctgccaaaaagaaaggcgtactccgtactcagaaattccctaacagaaaataagaagaagaagaaaaagaaaaagagaaaaaaaagcagctggggttaacatgtggagaagtctatggaatactccgtgcaggggttgtctttttcgttttctggggttcttctctattatttaattgtttttaccttcctcattaaatgtttctctacttatattccctctccctatacacgccgtaagtctaaacaagacatgattttcgctccggcgaaatacatggtttactctccttccgcccttgttaagcatttctgttcatcctgtaattaaagcttctatgtttggaaggttgttaatcacacacacaaaaggttagccattgttgagagcgcatggtgcggttccggtgtatccatcttcgatccagaccgctggcttcagccagcgaagagcaaaaacaaacatgacaaccgttttcatatggctccgagatcagcaaagtgtgtttttaaaccccaaaaataaacaggaaacgatcatgggagcatgggagcattcggccgttttcacgacaacaagcatcgccgaggcggttgcacagcccgccgaccactccgtagtccctccaggtagtcccattggattctgaccccggtaggtgttgacgtcgacaccccggaccacttgtctgacggcatactccttccccgcacgtccacagagtgctgctgagaaacagaattgacgtacacactcttgtcgacgaaaagaagttaataaagacagcccttggaaggaatctggataatcacatccacactccatgttattgccaatacagcatctcaactccaaggcagtgtgtggcagtcaacaatgaagctttcctcccttctcccgctggcgttcttgggccaggcggtgaacgccttgtcgcctgctgaatggcgcaagcagtccatctactttctgctgacggaccgtttcggccgtaccgataacagcacgtcagcaacatgcaataccggtgatagagtgagttgatggcgtcctaccctgtatgagatccacggaaacaacaaaacaaaactaacagtctaggcctactgtggtggcagctggcagggtgtcatcaaccatgtaagttttgtgcaatcccagtcagtatatagggctgcgcactgcggctaacgggacagctcgattacattcaggggatgggcttcacggccatatggattacacccgtgaccggccagttctacgaaagcacgggcgacggcacgtcctaccacggctactggcagcaagacatttactcgctgaactcgcacctcggtgatcagaatgacctcaaggctctgtctgctgcgctgcacgcgcgcggcatgtacttgatggtcgacgtggttgctaaccatatgggttatgacggtgccggctcaaatgtcgactatagcgtgtttgacgccttcccctcgtcaagctacttccactcgtactgcgagatttcaaactacgacgaccagtccaatgtcgaggactgctggctgggcgacacgaccgtgtctctgccggatcttaacaccgagcttacatcagtacgaagcatttggaactcatgggttgctggcctcgttgccaactactccagtacgtttatgccaacagaaaaccccccatatatgcccatgtaccctgctaatgcctctatagtcgatggtctgcgcatcgataccgtcaagcacgtcgagacatccttctggcccggatacaacgatgctgctggcgtctactgcgtcggcgaggtgtttgatggtgacccggcctacacttgtgcctaccagaactacatggacggtgtgctcaactaccctatctattaccagctgctgtctgcctttgagtctaccagtggaagcatcagcaatctttacaatatgatcaagtccgtggcatctgactgcgccgacccgacacttctcggaaactttatcgagaaccacgacaacccgcgctttgcttcatacacgagcgactactccctagcacagaatgccatctcgttcttgttcttctcagatggtatccccatcgtctactcgggccaggagcagcactacagcggcggtgccgacccggccaaccgcgaggccacgtggttgtcaggctactcgacaacggctacgctatacaaacacatcaaaacgaccaaccagatccgcagtctcattataggcaaggacagcagctgggccacgtcggccaacagcccgttctatcaagactccaataccattgccatgctcaagggctcagcttctggcagcaaggtcctgaccgtcctcagcaacaaaggtgcctctggctccagttatacgctgagtctcggtagtaccggctactcctcgggcgctagcctcgtcgagctgtactcgtgcacgaccgtcacggtcgacagcagcggcaacgtccccgtgcccatggcgtcgggcctgccacgcgtcttggtgccctcgtcctgggtctccggaagcggtctctgcggcacggcggttacgacaggcacagcaacagctacaggtacgtccacaaaggcaaccacagccacagcgaccacggccacctcgtgcactgctgcgaccgctgtttcggtcgtcttcaatgagttggcgaccactacatatggcgaaaatgtttacattattggttcgacttcacagctgggtagttggagcacggccaacgctattgccctctcgtcatcggactatacgtcgtccaatccactatggcatgttaccgtgtcgcttcctgccggatcgtcctttacgtacaaatttatcaagaaggagtccgacggcacctttgtctgggagagcgatcccaaccgctcctacactgtcccgacgggctgctctggcctttcggcaacagtgtcggccacctggaggtgattgtattcaaagtggaaggggcctgacaagctaatggagcttctctttatttgtatatattcactcttactatgtatattgtcactgcgactcattttgctgcttctacaccttaactttactatatttcgcggaggtgctggtagcgtattggttatatgacaggaaatagggctcttatttctcaatatagtatgttctatcatttactatgcatagccaaggttccagaagttttcaaggttcttctcagtgtcattgtccacatagtcatgtggtgcccggaacgtgacatgttcgccatgaatctcggccacgcctccagactgccgcaatgctgggtgtccttcaccgggaagacctcgaacaatctcgtccactcctcggactagcgatgacatcggtgtcgttgccatctttgtgaaaaggtccttgctcggggcaatgttagtctcaagcaccgctggggctaggccgtggatctggatggcagcccgttcaagtggtcttgacaatgcctgaacaaggccgatgacaccaaacttgctggcggcgtagatgggggcgataggaaatgggtagagaccggcgtttgaagcggtgcagataatgttgccacgcgtctgtggccggcctggagcggcatcggcaggacgggagagtgtgttctttctcatatagtgagtggcaagtttgacggctagcatattagtttgtttcttgtcatatgtacggcatgcgaaaacgttataacgcactatagatcgtccctaggaggttgacgttgagcgttcgcatagatggttccgatgggggggcttccgatgcactctccaacgcaccgagtgcctcagccaccagactcgactccccattctcggaaatgcccgcattggccataaccacgtcgattcttccaccaaaggttttgtaaacctgggcaaaggcatcagcctggctgtcccaagaggacacatcgcaagtaaagaatcgaacggctggttccgctggtcgtacaccgcccattttggaagcagcgctctgtagatcgtccgcaaccttgggtccgttccgagagtcgacgtcaagaaccgcgacatggccgtattgctgttcgacaaagtaccgggccatggcccgaccgataccactggcaccacctgtgacgaccgcaacccgggcttggttagccatttattttgaattgatgaggttgtatagttttatcagagtatggatgttataaaaatatgagaaggtccaagtataaaataatagatgagtgattcaattgttgaactttatatagtaacggtcccgaaatccatcggtaacaggttccggggtcctcggcagttgagctacatcggattctacttggactaagcaagatgctagggtccagcccgtcgaaagagctgtgcagttacataagacatgtattatgcttctgtttgagaaatcatatacaaaacagcagatgatgctgtttattctttcatcgataaattgcttttatctagctctgctattacagcacttattaccggaaggagagtcacaatactggtttcctaataacttattgaatgggttgccagtagtcttgtgttttggtacttttagtgaggctttgccctaagagcatgtgcatatgtgttgttttgcttttggctaataagagagctattggccatctactcggtatccattacgcgtacatgtagaagggctgggtacgtgaggaggagctgtaaccaggcactttatctcttatttagaacaggcacaaggatatttcacagtatcag

SEQ ID NO: 1942 - protein, 465 aa, OPHIOSTMA FLOCCOSUM
MKLSSLLPLAFLGQAVNALSPAEWRKQSIYFLLTDRFGRTDNSTSATCNTGDRAYCGGSWQGVINHLDYIQGMGFTAIWITPVTGQFYESTGDGTSYHGYWQQDIYSLNSHLGDQNDLKALSAALHARGMYLMVDVVANHMGYDGAGSNVDYSVFDAFPSSSYFHSYCEISNYDDQSNVEDCWLGDTTVSLPDLNTELTSVRSIWNSWVAGLVANYSIDGLRIDTVKHVETSFWPGYNDAAGVYCVGEVFDGDPAYTCAYQNYMDGVLNYPIYYQLLSAFESTSGSISNLYNMIKSVASDCADPTLLGNFIENHDNPRFASYTSDYSLAQNAISFLFFSDGIPIVYSGQEQHYSGGADPANREATWLSGYSTTATLYKHIKTTNQIRSLIIGKDSSWATSANSPFYQDSNTIAMLKGSASGSKVLTDLCLGERSQPLLHCPDGLLWPFGNSVGHLEVIVFKVEGA

SEQ ID NO: 1943 - protein, 630 aa, OPHIOSTMA FLOCCOSUM
MKLSSLLPLAFLGQAVNALSPAEWRKQSIYFLLTDRFGRTDNSTSATCNTGDRAYCGGSWQGVINHLDYIQGMGFTAIWITPVTGQFYESTGDGTSYHGYWQQDIYSLNSHLGDQNDLKALSAALHARGMYLMVDVVANHMGYDGAGSNVDYSVFDAFPSSSYFHSYCEISNYDDQSNVEDCWLGDTTVSLPDLNTELTSVRSIWNSWVAGLVANYSIDGLRIDTVKHVETSFWPGYNDAAGVYCVGEVFDGDPAYTCAYQNYMDGVLNYPIYYQLLSAFESTSGSISNLYNMIKSVASDCADPTLLGNFIENHDNPRFASYTSDYSLAQNAISFLFFSDGIPIVYSGQEQHYSGGADPANREATWLSGYSTTATLYKHIKTTNQIRSLIIGKDSSWATSANSPFYQDSNTIAMLKGSASGSKVLTVLSNKGASGSSYTLSLGSTGYSSGASLVELYSCTTVTVDSSGNVPVPMASGLPRVLVPSSWVSGSGLCGTAVTTGTATATGTSTKATTATATTATSCTAATAVSVVFNELATTTYGENVYIIGSTSQLGSWSTANAIALSSSDYTSSNPLWHVTVSLPAGSSFTYKFIKKESDGTFVWESDPNRSYTVPTGCSGLSATVSATWR

SEQ ID NO: 1944 - protein, 508 aa, OPHIOSTMA FLOCCOSUM
MKLSSLLPLAFLGQAVNALSPAEWRKQSIYFLLTDRFGRTDNSTSATCNTGDRAYCGGSWQGVINHLDYIQGMGFTAIWITPVTGQFYESTGDGTSYHGYWQQDIYSLNSHLGDQNDLKALSAALHARGMYLMVDVVANHMGYDGAGSNVDYSVFDAFPSSSYFHSYCEISNYDDQSNVEDCWLGDTTVSLPDLNTELTSVRSIWNSWVAGLVANYSIDGLRIDTVKHVETSFWPGYNDAAGVYCVGEVFDGDPAYTCAYQNYMDGVLNYPIYYQLLSAFESTSGSISNLYNMIKSVASDCADPTLLGNFIENHDNPRFASYTSDYSLAQNAISFLFFSDGIPIVYSGQEQHYSGGADPANREATWLSGYSTTATLYKHIKTTNQIRSLIIGKDSSWATSANSPFYQDSNTIAMLKGSASGSKVLTVLSNKGASGSSYTLSLGSTGYSSGASLVELYSCTTVTVDSSGNVPVPMASGLPRVLVPSSWVSGSGLCGTAVTTGTATATAG

SEQ ID NO: 1945 - DNA, 3200 bp, Ajellomyces capsulatus
atatagatacccaggatatctgtctccccaatcccatctccatcttcccatccgcatatctatatcagagagccctgttctttcgtcaattcctctcattccaaggttacccctgaactacccattggcctatcacaacccgaggcccaagtgcccctgaaaccttatctaacgccttgaaaagtttcaaacttggagaacatcaggatcacacctcttgagagaaaatagagcagagaagagaagaccaaggaccaagctgtttatgcatatccactaagacgtacgtgtgcatgtgtgcgtgaacacatgcgtatgcggtgatgttttgaattttcgtttttcatattttgaagagaagaaaagaaagaaaaaaatagactgtctgcatttggttgctgaaggtgatcctgttgagactgcttaagacggcatctgttgggacactcatgttgcgggagaatggggtcttttatatcgtcggcctaccagcacatatttcgaaagcgggagacgcaatggcttgacattgacggtgagtatttcttacatttctgttcctctgaagtactttattttaagttggctttcacggggtgctttacgcttcctgttttttcttgtttcaatttatctgtctgttttcttaaattcatttcttgtgggttgatcattttttttttattctactgttttctgttttttgcttgtgtatttgatggaaacgcttcagctccaaacacgttggtcgttatcatcctgtcgcctttttttttggtttttttttttttttttttttttttgaacacaatggccacaaatttccttcgctaaacaatttcctcagacttcgaccttgacgagccgggtgagccaaaccagctgatgtttcaggccttcgagtggtacgtgcctgatgatcagcgacattggctacggctgcgggcagccctaccaagtctcaaggaaatcggagtgaccagcatcctgctcccaccaggctgtaaggccatgagcccgtccggcaatggatatgagttgtatgacctttacgacctaggtgagttctatcagaaagggtcgagggccaccaaatggggaactaaggaagagctggttgctcttgtgactaaggcgcatgagatggagatccggatcatttgggatacggtgcttaatcataaggctggagctgatcatacggagaagtgtaatgcggtgatggttcatccgaaaggtgggtttctggccatctaatctgagtttgctaatggagaatggggatggggatgttaatatgtctatggacaccaaaatatacaagtgccttgttgatactaattctaaagccaaaattttagaccgccggaaagtcatcagtaagcccgtggagattgaagcttggctgggttttacctttcctggccggggggaacggtacagtgagatgaaatatcattggtaccatttttcaggagtcgattttgatgcccgtaataagaacaagggaatatataaaatcttggggcctgataagaacaaagactgggcgcgggacgtcagcaaggagaatggcaactacgactatttgatgttttcaaatctagattattcgaacccagaagttcgtgaggacgtcttcaagtggattgaatggatgggtcaccagctaccactttcaggcctaaggttggacgctgccaagcatgtttcatctgggtttttgaaggactttgtcgctcacgttcggcgaacggttggacccggctggttgcttgtggctgaatattggaaggcggaagttcgcgagcttctggagtatctagggcgaatggattacattgtctctttatttgatgcgccattagtccgccggttttcagatatttccagatcagaattcgcagatttgcgtaaggtttttgaggggagtttggttaaatatgagcggaaacatgctgtggtacgttttgaaaccgaatccttttttcatctagtcgaccaggttaatgctaacttaccggacactggatagaccttcgtgatgaaccatgatactgtaagctatccccccacaaacttgaatctcatttcaaatttctaacaactatccagcaaccatcgcaatcgctcgaggtaaattgtcctcaaggaccggtcggctaccaaaaggatacatcaaccatcagactcaactaacaaccaaccaggaaccgatagcagatttcttcaaaccgctcgcatatgcactcattctcctgcgcaaggagggatacccgtgtcttttctacggcgatctatacggagtgtgcggtggctgcaaggggatcctcaaaccctcctgcaacgacaaactagcagatctagcgctcgctagaaatttatacgcatacggtcgacagcgagattattttgataaaaggcattgtattggtaagtgtctgccccttgctcataccacatattctcaaatatttcgtatccgacgccctggttgattaattgacactccccgtgcaggattcgtccgtttcggtgattcgggacatcctgatggactggcctgcgtccttagcaatggccccgcagccacgaagcgcatgtatgtaggaaaagcgcatgcggatagtgtctggacggagatatatggctactgtcgctccagagtaaagatagatagtcgcggttatggcgtttttggtgtggtggcgcgtaacgtgagtgtctgggttcgggaagatgcggcaggcagggagcgttttgggaagttgtatgtgactgcctttttcttttgtatcccccccccccaccccttcccgcgtttgaacatcctttgatttatttcaagcttctttaataagtggaggctaatctcaacattaatataatacccagtgattcggatatctactcatctctacagggtgaccattgatattccagtacccatcctctattttctttctttttcccttctttttttttggatctccatatgtgcccataattgtgagcacatctcctttttccacactcactaccaccccttcatccggtgttgtatattgcaaatttttaagtcttcgaatcttggagtatgggtcaaggttggtttaaaagctttgactttatagtcacattttaatgtttgcttctttctgatttgcctaactagaatataagattttaatctaatccgt

SEQ ID NO: 1946 - protein, 540 aa, Ajellomyces capsulatus
MGSFISSAYQHIFRKRETQWLDIDDFDLDEPGEPNQLMFQAFEWYVPDDQRHWLRLRAALPSLKEIGVTSILLPPGCKAMSPSGNGYELYDLYDLGEFYQKGSRATKWGTKEELVALVTKAHEMEIRIIWDTVLNHKAGADHTEKCNAVMVHPKDRRKVISKPVEIEAWLGFTFPGRGERYSEMKYHWYHFSGVDFDARNKNKGIYKILGPDKNKDWARDVSKENGNYDYLMFSNLDYSNPEVREDVFKWIEWMGHQLPLSGLRLDAAKHVSSGFLKDFVAHVRRTVGPGWLLVAEYWKAEVRELLEYLGRMDYIVSLFDAPLVRRFSDISRSEFADLRKVFEGSLVKYERKHAVTFVMNHDTQPSQSLEEPIADFFKPLAYALILLRKEGYPCLFYGDLYGVCGGCKGILKPSCNDKLADLALARNLYAYGRQRDYFDKRHCIGFVRFGDSGHPDGLACVLSNGPAATKRMYVGKAHADSVWTEIYGYCRSRVKIDSRGYGVFGVVARNVSVWVREDAAGRERFGKFDSDIYSSLQGDH

SEQ ID NO: 1947 - DNA, 3146 bp, Aspergillus oryzae
tcatggtgttttgatcattttaaatttttatatggcgggtggtgggcaactcgcttgcgcgggcaactcgcttaccgattacgttagggctgatatttacgtaaaaatcgtcaagggatgcaagaccaaagtagtaaaaccccggagtcaacagcatccaagcccaagtccttcacggagaaaccccagcgtccacatcacgagcgaaggaccacctctaggcatcggacgcaccatccaaatagaagcagcaaagcgaaacagcccaagaaaaaggtcggcccgtcggccttttctgcaacgctgatcacgggcagcgatccaaccaacaccctccagagtgactaggggcggaaatttaaagggattaatttccactcaaccacaaatcacagtcgtccccggtattgtcctgcagaatgcaatttaaactcttctgcgaatcgcttggattccccgcccctggccgtagagcttaaagtatgtcccttgtcgatgcgatgtatcacaacatataaatactagcaagggatgccatgcttggaggatagcaaccgacaacatcacatcaagctctcccttctctgaacaataaaccccacagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcgggtgtgttgttacctactagctttcagaaagaggaatgtaaactgacttgatatagaaatactgtggtggaacatggcagggcatcatcgacaaggtaaattgcccctttatcaaaaaaaaagaaggaaaagcagaagaaaaataaaataaaaagaactctagtcctaaccatcacatagttggactatatccagggaatgggcttcacagccatctggatcacccccgttacagcccagctgccccagaccaccgcatatggagatgcctaccatggctactggcagcaggatatgtaagtcgatttctttaaatatctacctgtcatcttttacatcaatatgaactaacttgatggttttagatactctctgaacgaaaactacggcactgcagatgacttgaaggcgctctcttcggcccttcatgagagggggatgtatcttatggtcgatgtggttgctaaccatatggttcgtggtcctttgcaactgacttcgcggatatggttcatttcagtactgacaatgagtaatatcagggctatgatggagcgggtagctcagtcgattacagtgtgtttaaaccgttcagttcccaagactacttccacccgttctgtctcattcaaaactatgaagatcagactcaggttgaggattgctggctaggagataacactgtctccttgcctgatctcgataccaccaaggatgtggtcaagaatgaatggtacgactgggtgggatcattggtatcgaactactccagtaagatatttctccctcattctacaacttggctgatcgatgatacttacgaaatcagttgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatgtatggttcctccaaccatgagccttcttgcaagtctcatctcctaacgaaacggctaaaaccagttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcgtaagtcttcccttttattttccgttcccaatttccacacagaaccccacctaacaagagcaaagttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaaggtaagcacaacctctaagcataccctaatggcctatcttcagagtatctgacacaagagactaatcactggcaatacagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttgatgtaacttgtctattctatgatgtatggtctttttgttctatagttggaaatcggaatgatctcaaatcttgaataaatataaaaaggataatactcacatccatcacaaccttacaaggttaattccgagctatattccaccgacacaaataggcagtatcttctctcgccagagaatcgcgatattattggcatgcaaataacgataactgtctccagaaggtaaatatatgcagtcttgaaacctaaacaaggcttctcaatccattgattctcagtgatatcctcttacgagaatagggaaggtatataccgttgctggggttgcgtttaggctaaattcgtatgatagttgaatctgtttggatgggtatgctgtggttttatttggcatatcattagggtttgacctggtggttgctcg

SEQ ID NO: 1948 - protein, 499 aa, Aspergillus oryzae
MMVAWWSLFLYGLQVAAPALAATPADWRSQSIYFLLTDRFARTDGSTTATCNTADRKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 1949 - DNA, 1946 bp, Lipomyces starkeyi
atgttgctgatcaactttttcatcgctgttctgggagtgatatcactgtctcctattgtggttgctcgttatattcttcgacgagattgcactacagttacggtcttgtcctcccctgagtctgtgacgagttcgaaccatgttcagctagccagtcatgagatgtgcgacagtaccttgtcagcgtccctttatatctacaatgatgattatgataagattgtgacactttattatcttacatcgtcgggcacaactgggtccgtaacagcgtcttattcttctagtttgagtaacaactgggaattgtggtctctctcggctccggctgcagatgctgtcgagatcactggagctagttatgtagacagcgatgcatctgcgacatacgccacgtcttttgatatacctcttactaccacgacaacgtcgtcgtcttctgctagtgcgacttcaacatctagtctaaccacaacatctagtgtttccatttcggtgtccgtccctacaggaacagctgcaaattggcgaggtagggctatctatcagatcgtgactgatagatttgcacgcactgacggctccaccacatatttatgcgatgttaccgatagggtctattgcggagggtcttatcaggggattatcaatatgctggattacatccaaggcatgggctttactgctatttggatttctcctatagtggaaaatattcccgatgacaccggatacggttacgcatatcatggttattggatgaaagatatcttcgccctgaatacaaattttggtactgcagacgatttgatagcgttggctacggaattgcataatcgcggcatgtacttgatggttgatattgttgtcaatcactttgctttctcaggaagtcatgccgacgtggactactctgaatatttcccgtattcgtcccaggattattttcattcattttgctggattacagattactcgaatcagacaaacgttgagcagtgctggcttggcgacgatactgttcctctcgtggacgtcaatacccaacttgacaccgtgaaaagtgaatatcaatcctgggttcaagaacttatagctaattactctattgacggcctaagaattgacaccgtcaagcacgtgcagatggatttttgggcaccatttcaagaggctgcagggatttacgccgttggtgaagtattcgacggtgatccatcctacacatgtccatatcaggaaaatcttgacggtgtcttgaattatcctgtttattatcctgtcgtctctgcgtttgagagtgttagtgggtcggtctcctcgttagtcgatatgattgatacgctcaagtctgaatgcaccgacactactctcctaggctcctttctagagaatcaagataatccgcgattccctagctacacttctgatgagtctttaattaaaaatgcgatcgctttcactatgctctcagacggcattcccataatttattacggtcaggagcaaggcctcaatggtggaaacgatccctataatcgagaggcgctttggcttacgggctactccacaacgtcgacgttctacaaatacattgcgtcgttgaatcagattagaaatcaggctatatacaaagatgatacttatctcacatatcagaactgggttatttattcggattccacgacaatagcaatgcggaaaggttttacagggaaccaaataattacggttctgtcaaatcttgggaccagtggcagttcgtacactttgacgctttcgaatacgggatataccgcatctagcgttgtatatgagatcttgacatgcacagctgtgactgtggattcgtctgggaatttggcagtgccgatgtccagtggcctaccaaaagtcttttatcaggaatcgcaactggttggctctggaatctgctccatgtagag

SEQ ID NO: 1950 - protein, 647 aa, Lipomyces starkeyi
MLLINFFIAVLGVISLSPIVVARYILRRDCTTVTVLSSPESVTSSNHVQLASHEMCDSTLSASLYIYNDDYDKIVTLYYLTSSGTTGSVTASYSSSLSNNWELWSLSAPAADAVEITGASYVDSDASATYATSFDIPLTTTTTSSSSASATSTSSLTTTSSVSISVSVPTGTAANWRGRAIYQIVTDRFARTDGSTTYLCDVTDRVYCGGSYQGIINMLDYIQGMGFTAIWISPIVENIPDDTGYGYAYHGYWMKDIFALNTNFGTADDLIALATELHNRGMYLMVDIVVNHFAFSGSHADVDYSEYFPYSSQDYFHSFCWITDYSNQTNVEQCWLGDDTVPLVDVNTQLDTVKSEYQSWVQELIANYSIDGLRIDTVKHVQMDFWAPFQEAAGIYAVGEVFDGDPSYTCPYQENLDGVLNYPVYYPVVSAFESVSGSVSSLVDMIDTLKSECTDTTLLGSFLENQDNPRFPSYTSDESLIKNAIAFTMLSDGIPIIYYGQEQGLNGGNDPYNREALWLTGYSTTSTFYKYIASLNQIRNQAIYKDDTYLTYQNWVIYSDSTTIAMRKGFTGNQIITVLSNLGTSGSSYTLTLSNTGYTASSVVYEILTCTAVTVDSSGNLAVPMSSGLPKVFYQESQLVGSGICSM

SEQ ID NO: 1951 - DNA, 1762 bp, CRYPTOCOCCUS NEOFORMANS
gatcatgctcgtccccttttccatatccctctccatattaccattgctcctcacttctctctcttccagcgccctaccccaatcggaactgcggcatcgctcagtctaccaactccttacagatcgctttgcccgaccagaccagcagattgcaccctgtgatgttgcaaaaaaggagtactgtggaggaggatggaagggtgtggagcagaggctggattatataaaagggatggggttcgatacaatttggatatcgccgatcgtcgccaacatccaacttgacccaggtgcacgttcatttcacggggacccatatcatggctactggggttccaacatatatgagctaaatcaccatttcggaactccccaggacttgcttgacctcagccaagcactacataatagaggcatgtatcttatggtggatgtcgtagcaaatcatgtcggagcgcaggaccacgtatctttcgtgccctcttccgattatggtcccttttcgtcgccttctgatttccacgagtactgtcagcctgactgggatgttcaggaagaaatcgagcaatgctgggtcggttctcaaacgccggacctcaacaccgaatccccccatgtcatctccacgctcaacacctggatccaccatctcgtttccacgttccaaatagacgctctccgcatcgacactgtcaagcacgtcaggaaagatttctggaaaggttttatagagagcgcaggtgtagcgtgtttgggagaagtattgaatggagacccgacgtatttggcgctatatcagagggaagcgatggggagtatatttgactttgccacgtactggcatattcaacgggcattccagtctccgctggggtcgatatcagagctggtgaacatgatcaaactccttcatcgacttttcccagacccatcatcactaggatcttttctcgataatcatgacttccccaggtttgctggtaagaccgatgatcaggctcttattcgcaatgcgatggtttatcctttcatcaacgatggctatccaatcctctattcgggccaagaacataatctgcaaggcggggatgatccctataacagggaagcaatttggctatttggatatgacgagtcttctcctacatacaatatgatcaaatccctcaataacgcccgccgtatcgcatcgtcatccccatcattccccgcccttctccgccctttccagcacggtaaccataccatcgttatgtccaaagctcccctcctttccatcctcaacaaccacggttcttcgtcatgtcatataacaggaggggcaagagctatcccgatgcatatccccccgtcgcaaacagggtacaaaggtcttctccccgttattaacgtcttgaccggacgaatatactctaccgatccttacggtggactaactatcactatcgtccgaggcgaacctctcgtcttcattcctcttatcctttaccactctcccaaccctgtggaagtgccggatagtgagtggaagggggtgctgataaatgaaaaagggaaggggaagcggagcgggaaggacggtgaaggagatgaggataggccggagatgacgaggaggtggagtcccgcgggaccgtggagcccaaggatgatgagcggatttggaggctggatgggatggtggagagggtggggaagtgggggtggtaacggggatttgtgaaaaggacttttgtttgtttatgtgaggtctgaagtgggc

SEQ ID NO: 1952 - protein, 572 aa, CRYPTOCOCCUS NEOFORMANS
MLVPFSISLSILPLLLTSLSSSALPQSELRHRSVYQLLTDRFARPDQQIAPCDVAKKEYCGGGWKGVEQRLDYIKGMGFDTIWISPIVANIQLDPGARSFHGDPYHGYWGSNIYELNHHFGTPQDLLDLSQALHNRGMYLMVDVVANHVGAQDHVSFVPSSDYGPFSSPSDFHEYCQPDWDVQEEIEQCWVGSQTPDLNTESPHVISTLNTWIHHLVSTFQIDALRIDTVKHVRKDFWKGFIESAGVACLGEVLNGDPTYLALYQREAMGSIFDFATYWHIQRAFQSPLGSISELVNMIKLLHRLFPDPSSLGSFLDNHDFPRFAGKTDDQALIRNAMVYPFINDGYPILYSGQEHNLQGGDDPYNREAIWLFGYDESSPTYNMIKSLNNARRIASSSPSFPALLRPFQHGNHTIVMSKAPLLSILNNHGSSSCHITGGARAIPMHIPPSQTGYKGLLPVINVLTGRIYSTDPYGGLTITIVRGEPLVFIPLILYHSPNPVEVPDSEWKGVLINEKGKGKRSGKDGEGDEDRPEMTRRWSPAGPWSPRMMSGFGGWMGWWRGWGSGGGNGDL

SEQ ID NO: 1953 - DNA, 1734 bp, Aspergillus oryzae
tcacatcaagctctcccttctctgaacaataaaccccacagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttgatgtacagttggagtcgttactgctgtcatccccttatactcttcgattgtttttcgaaccctaatgccaagcacgctagtctattataggaaaaaaaaaaaaaaaaaaaaaaaaaaaaaa

SEQ ID NO: 1954 - DNA, 1713 bp, Candida albicans
atgagtgaacacaagtggtggaaagaagctgttgtttatcaaatttggccggcatcatacaaggattccaatggtgatggtgttggtgatattccaggaattatttcgacgttagactatattgcgagtttgggagtgacaaccgtatggttgagtcctatgtatgactcgccccaagatgacatggggtacgatgtttctgattacgaaaatgtctacagcaaatacgggaccttgcaggatatggacagattaattgctggttgtcatgacagagggttgaagttgatacttgacttggttatcaaccacacttcggttgagcacaagtggtttaaagagtcgagactgtcgaaggacaacccgaaaagagactggtacatttggaaaccacctagaatcgatagcaatggtaacaaacacccgccaaataattgggggtcatatttttctgggtcggcatggaagtatgatgagttgactggtgagtactacttgcacttgtttgctgaatcacaacctgatttgaattgggaaaacaaggagtgcagagaagctatttataactcggccatcaagttctggttggacaagggtgttgatgggtttagaattgacactgcaggaatgtactccaagtaccagcatttcaaagatgtgcctgttgcttttcctgatactgaattccagccttgtgaaatctaccacaagaatggtccaagaattcatgagttccacaaggagatggccaaggtaatggagccatacgatacgatgactgttggagaggttggccattcgactagagagcaggcgttaaagtatgttagtgctgctgaaaaagaaatgaatatgatgtttttatttgacgttgttgagttgggctcggacccacgtgacagattccgttacaatgggtttgacttggttgatttaaagaaggctatcaaatcacaaggtgagtttgctgagggaaccgatgcttggtctactgtatttattgaaaaccatgatcaggcaagagccattagcagatttggtaatgactcgccagagtttagggtgttgtcaggtaaggctattgccatgttgcagtgttgtctcactgggactttgtttatttatcagggtcaggagattggtatgaccaatgtgccaagatcatggccaattgaggagtacaaggatatcaacaccatcaattattaccgtgcctttaaggaaaagtatggcaaagatgctgattataaacagaaggaagaaaagttggttgatgttattaaccgtttggctagagataatgctagaacgccggttcagtggagccaccaacaatatgctgggttttcagaggttgagccgtggatgagagtgaatgacaactataaggagattaatgttgaggaccaggacggtgacgaccattcattgcttaacttttatagaaagttgttgaagttgaggggagagtacaaggatctttttgtttatggggagatgaagtttttagattttgatgacaagaagcttttcacgtttgccaaggaagcgcctggctctcctgttgcatacattgtgatcaactttagtggtgaggatgtcaagtttgagccgttgattaagggtaattacaagttggtacttacaaatgtcgacaaagacagtaaagacgctttgtctccatacgaggctagaatgtatgtagttgattaa

SEQ ID NO: 1955 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRSSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDVPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 1956 - DNA, 2293 bp, SCHWANNIOMYCES OCCIDENTALIS
ggtacctgagctaaatttagaaccggctatagatccgcttgtctaaagaagagataatgaagaaaacaattaaccgagcactcttattaagtttttttctattttcttttgctcctacttcaataatttatctaaattgtattgtgcgttagatcagaatgtactgataacagagagtattatcatacacttgtggatttcaaaaggcggaatcaaaagcatacgtagtcaaacccttggttatttgatgcaattaaggttgtagtcgttcttaccgatccatcattataccccacacggtttcatggtatgtaggtgtttcaatagtgaagtacaatgaatgttttggtaatgctgtatgtggatcagtaattatgttaaacaattaagtctgaaaatttattaaaattttacctacaaattaagccgaaatccaatcgaaggtgccgcccagctggtgtataaattactcttgaaattcaagttgaacgttgatctctctaaagcaaagctgttattctacaatactaaataaaataaaagcaagacatgagattttcaactgaaggatttacaagtaaagttgttgcagcaattttagcattctcaagattggtatctgctcaaccgattatttttgacatgagagatgttagctcgtcagctgataaatggaaagaccaatcgatttatcaaatcgttactgataggtttgccagatctgatggctcgaccacagctgactgtttagtgagtgatcgcaagtactgtggtggatcttataaagggattatcgacaagttggattatattcaaggtatgggtttcactgcgatctggatctccccagttgttgagcaaattcctgacaatactgcttatggttatgcttaccatggttattggatgaaaaatattgatgaattgaacactaattttggtaccgctgatgaattgaaacaattagctagcgaattgcattccagaagcatgttattgatggtcgacgttgtttacaaccattatgcttggaacggagatggttcaagcgtagattattctagtttcactccattcaatcaacaatcttacttccacgattattgtttgattacaaattataatgatcaaaccaatgttgaagattgttgggaaggtgatactgaagtctcccttccagatttaagtaccgaggataatgaagttataggagtatttcaaacttgggtgtcagattttgttcaaaactattcaatcgatggtttaagaattgatagtgcaaagcacgtagataccgcttcattaacgaagtttgaggacgcttctggtgtttataacttaggtgaagtttatcaaggagatccaacttatacttgtccatatcagaattatatgaaaggagttaccaactatccattatactatccagtatatagattcttcagtgatacttcggcgacttccagtgagttaacttcaatgatctccacgttacagtcatcttgttcggacgtctctttgttgggaaactttattgaaaaccatgaccaagttagatttccatcagttacctcagacacatccttgattaagaatgacatggcttttataattttgggtgatggtatcccaattatttattatggccaagaacaaggtctcaatggtggttccgatcctgccaatagagaagctttatggttaagtggatataataccgattcagaatactacgagctaatcagtaaactaaatcaaataagaaatcaagctattaagaaggattctgcctattcaacttacaaatcctcagttgtttcttcttcagaccactatatagccactaggaagggtagcgatgctaatcaattgatttccatttttaataatttaggttcaaacgggtcacaggatattactgtcagcaacaccggctattctagtggtgataaagttatcgatattatttcttgcaattccgttttagctggtgactccggaagcttatctgtatcaatttctggtggaatgccacaagtttacgctccgtcctctgttctttcgggatctggcatctgcaatcaatagattgatccagcgctaaccctttttttagcaacgacaagtttattttagaaaaagttttctaagaatggtcaaaacaagttcttattacttctatgtccctggatatctgttttcaatgttctctgactccacattcctcatgtttagttctctattttttgtcgatcttctaagtttttttattcttaattttaatccaaaagtt

SEQ ID NO: 1957 - protein, 512 aa, SCHWANNIOMYCES OCCIDENTALIS
MRFSTEGFTSKVVAAILAFSRLVSAQPIIFDMRDVSSSADKWKDQSIYQIVTDRFARSDGSTTADCLVSDRKYCGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQNYMKGVTNYPLYYPVYRFFSDTSATSSELTSMISTLQSSCSDVSLLGNFIENHDQVRFPSVTSDTSLIKNDMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVLAGDSGSLSVSISGGMPQVYAPSSVLSGSGICNQ

SEQ ID NO: 1958 - DNA, 3680 bp, Emericella nidulans
aagctttggggactcagatccgttcgaggggtggaggcactgcaaaatgctgattggtcatatctccgacaaaagaccgagcctataacgaagctgttatagtcgaggatagttgatatcaaggatgcaggatacgaaggtcgaagcaccgggtgatggaagaggatgaagagaggagattgtggagtgttaactctcagccaagctattctgtacggagtatctacccagagcagggttcatccccagaataccgtattgtgtgcgtaatgttacgggcgtgccatgcctaaaattaccaccggtgagcaactccagtctccagccttcccgctaaccccagtccccgaccagactgagaacagtcgacttgatcgatttcctggataatccggagtctggactgctagctatgctctcggcaccatgagtatcacatgaaatcatgaaatccagacatccagcgcttcgttatcctaaaactcaaacagacctcgagattgagactggaatcgggccccctcccagaacccacggtggagaacggtcgctgcacatcaacaccaccaagacgatgtacgaggattcggcatctgtggttggcactgcatcggttccttgggtcatgctgctgttcctcggcttcccgacagacttgggcccttaagtgagccacagaagcccgatttctaaagaggcgttcatgtcttactcgacactgacgaatggccagcgcaggggacgaccgctagaccaaggatcacacaggcaaatgggcttcatgcaggggaggtttctagaaaatcgcgcatgctgccaagacgtcatactgggcaacaatcccggatccaggattcaggggtttctgacagccggctctcgggcctggctgtagccgtcacctcgctcttttctctgggcaaaaggtggcaggctggagtgcagtccaccggcaaagctaacgcgaagaagccttaaatgaactgttaagggttgctaagagacgaagccgagaagcaatggtgtaacgcggggctgagcctgactacggctgcaggcactacggagtactatacggagggcaagcggatagtggagttagtgtcactgctatccgattactcctgcccgtctctctttatcctctccctcccccgctcgctttccccagattttcacccatgcgtacgtctgcaaggactatagcgattttatactgttgacgagcaatccgacatgacccgcatgcctcttcaagactagcttctcatctaccggcactgctcatatcgttcgcctttggcccggccatcgtgcaccatggcctcaccagccgctccgaaacacaaacctttcaagcaggcctgtgacaactgtcgccggaggaaaatcaagtgctcacgagagctcccgtgcgacaagtgccagcgcctgctcctttcctgctcctacagcgatgtgctgcgtcgcaaagggccgaaatttcggactctataccctctagcgcctatccatccactagtggccagagaccgacagattctccagtatgatcctccacgattctctgcagagagggaatggtatgcagagcctacgagctacccggtcggcggctcgcccacgtctccgcccttcatggaagagccgcaatatctgccgcctgaacaccctgactcattcagccggctgcctccaccagaactcgtctcttcgccggattctctgaactccctatcggactctccgactgcggtgctgtttcgttcgccgcggattctgaccgcacctgtgcttctggcgcacgtcaatgtctacttgaaatatatgtttcctatcatgcccgtggtccgaagagaagagctccagcaggactgccaccatccagagcgtctaactccccagcggtacgcctttctggcctccctatgtgccgccacacatatccagctgaaactcgacggagcaacgcccgtcgcggatccttcgcattttcaggccggtgagaactcatcaatgtccggtgaagaactgctcgccgaagccgtgcgcgcaaggaaagattgcgacccaattgaggatatgaatgttgagagtcttctaacctcattcttcctatttgcttcatacggaaatctagaccgccaggaccacgcatggttctatctttgccaggcgacatcaatggttttcgcattgggcttgcaccgcgaatcaacatacgccgagttgaacaccgaagaagcagaacagaagcgacgggtcttctggctgctcttcatcacagaacggtatttacctccgtagagctgaatagaccataaactgacaagtgctgcagaggctatgccctccaacaagcgaaacctgtcatgctccgcaactccatccacaaaccgcaagtcctgtgctccgacgacccgattctcgcctacggcttcatcaacctcatcggcgtcttcgagagcctcagcgtcaacctttacgactgggtctcagcagggggaagcgtaagcggaggtggaaataaccgagacggctcctccgagatgccgcctacatcagccatccaggcaactctcagcaaaccgatctcgctcgagggtgtctcggaaatccaaaaggttgatatcctcatcacacagcagtggcttcaggccatgatgtggaaactctccatgacgcgtgcatcgcagccaggctcgcggaatgagacggtcctcccgttccatcttcctgtaatggtgggcaaggctgttatgtctgtcattgcggaggcatcgcagggggctgtcgacgcgcatgggattgggatggtagtcttcaccactttagcaatttacttcgattaaggctgacgattacgcaggaacaaaagctcttcgatcttggtacatctatcgccgacgtctcacgttctctctccacaaaagctgcaaacagcctcgccgagtcaaccgtcgacccccgcgagctcctctggggtatcctttccaccctctcccgcatccgtggctcccagtcgtacctcttcccatctctccttgagcgctgcaaaggcaccctcggctttgattccccgacgccgctttctatcagtgacttccaccagattaatcctccgcttctcaattccgctagctcttcttcaattgcttctgaaactttagatatctctggaccatggcccgcggctgatgacaatactatggattctagcacaggcagcaggacaacaaattcgtgtgcatgggaaataacttctggtgatacgaacgaccagaaccagactagtgatcagccgccttcattgtctggatcatcgtcagtacccctttcggtctcgcgaatgcattcgtccactagtatggctgcagaactctcgtttcaagctgggaggttattgacttgacttctggactggctccaccaccaccactacctcctcctcctcctcctcctcctcctcctcctcacccttctgctctcctccctaattcgcccatacaaagaaagggtatatatatcgctaccgaggattctaggttgttatatatctatcaacctgtcggagatattggactgtgttttgcacatctgcgtatcttcccaacgtctttactccctccatgtatctatcatccttattatcactatctctccaccctcatacctattgc

SEQ ID NO: 1959 - protein, 662 aa, Emericella nidulans
MASPAAPKHKPFKQACDNCRRRKIKCSRELPCDKCQRLLLSCSYSDVLRRKGPKFRTLYPLAPIHPLVARDRQILQYDPPRFSAEREWYAEPTSYPVGGSPTSPPFMEEPQYLPPEHPDSFSRLPPPELVSSPDSLNSLSDSPTAVLFRSPRILTAPVLLAHVNVYLKYMFPIMPVVRREELQQDCHHPERLTPQRYAFLASLCAATHIQLKLDGATPVADPSHFQAGENSSMSGEELLAEAVRARKDCDPIEDMNVESLLTSFFLFASYGNLDRQDHAWFYLCQATSMVFALGLHRESTYAELNTEEAEQKRRVFWLLFITERGYALQQAKPVMLRNSIHKPQVLCSDDPILAYGFINLIGVFESLSVNLYDWVSAGGSVSGGGNNRDGSSEMPPTSAIQATLSKPISLEGVSEIQKVDILITQQWLQAMMWKLSMTRASQPGSRNETVLPFHLPVMVGKAVMSVIAEASQGAVDAHGIGMEQKLFDLGTSIADVSRSLSTKAANSLAESTVDPRELLWGILSTLSRIRGSQSYLFPSLLERCKGTLGFDSPTPLSISDFHQINPPLLNSASSSSIASETLDISGPWPAADDNTMDSSTGSRTTNSCAWEITSGDTNDQNQTSDQPPSLSGSSSVPLSVSRMHSSTSMAAELSFQAGRLLT

SEQ ID NO: 1960 - DNA, 2239 bp, Lipomyces kononenkoae
ggcacgaggatttcgcaactatattaaggtcctcgaattaccctttttcaacttcaggacaaatcaatctataacaacaatgttgctgatcaactttttcatcgctgttctgggagtgatatcactgtctcctattgtggttgctcgttatattcttcgacgagattgcactacagttacggtcttgtcctcccctgagtctgtgacgggttcgaaccatgtccagctagccagttatgagatgtgtggcagtacactgtcggcatccctctatgtttacaatgatgactacgacaagattgtgacactttactatcttacatcatcgggtactactggctctacactggcacttattcttccagtttggagtaacaactgggaattatggactctctcggctatagctgcaggtgctgtcgagatcactggagctagttatgtcgacagcgatacatctgtgacatacacgacgtctttggatttgcctcttacgaccacttccgcgtctgtccctacaggaacagctgcaaattggcgaggtaggtctatctatcaggtcgtaactgatagatttgcacgcactgatggctccattacatattcatgcgacgtcaccgatagggtctattgcggagggtcttaccgggggatcatcaacatgctggattacatccaaggcatgggttttactgctatttggatatctcctatagtggaaaatattccggatgacaccggctacggttacgcatatcatggttattggatgaaagatatcttcgccttgaatacaaattttggtggtgcagatgatttgattgcattggctaccgagttgcataaccgtggcatgtacttgatggtcgatattgttgtcaatcactttgcgttctcaggaaaccatgccgacgtcgattactctgaatatttcccatattcgtctcaggattattttcattcattttgctggattacggattactcaaatcaaacaaacgttgaggagtgctggctcggcgacgactctgttcctctcgtggacgttaatacacaacttgacaccgtgaaaagtgaatatcagtcctgggttaaacaacttatagctaattactctattgatggtctgagaattgacactgtcaagcatgtgcagatggatttttgggcgccatttcaagaggcagcagggatttacactgttggtgaagtattcgatggtgatccatcctatacatgtccgtatcaagaaaatctcgacggtgttttgaattatcccgtttattatcctgttgtctctgcttttcagcgtgttggtgggtcgatatcctcgttagtcgatatgattgatacgctcaagtctgaatgcatcgacactactctcctggggtcctttctagagaatcaggataatccgcgattccctagctacacttctgatgagtctttaattaaaaatgcgattgctttcactatactctcagacggcattcccataatatattacggccaagagcaaggactcaatggtggaaatgatccctataatcgagaggcgctttggcctacaggctattccacaacctcaacgttttacgaatacatcgcgtcgctgaatcagatcagaaatcatgctatatacatagatgatacttatcttacatatcagaattgggttatttattcggattccacgactatagcaatgcggaaaggatttacggggaaccaaatcattactgttctatcaaatcttgggtccagtggcagttcgtacactttgacgctttccaatacgggatatactgcatctagcgttgtatatgagatcttgacatgcacagctgtcactgtggatttgtccggaaatttggcagtgccaatgtccggtggcttaccgagagtgttttaccccgaatcgcaactggttggctctggaatctgctccatgtagagagcatataaagtctgtcgcttggcgactgaaagccaacgaatggaatctttgtgctggttattttgagattctttatgggaggaaacctagtctaattaggaaatttcttgttcctcgctacgttgagtgagtttttgcctaaagtttcttcggttctatgtatccgcttgccttcaggggtgaatcttgcttctgcttgccttctggcgcattgggccctctattctcaattgtataagtcgttctttctttaaccaaaaatcccactccttcgtctatcat

SEQ ID NO: 1961 - protein, 570 aa, Lipomyces kononenkoae
MCGSTLSASLYVYNDDYDKIVTLYYLTSSGTTGSTLALILPVWSNNWELWTLSAIAAGAVEITGASYVDSDTSVTYTTSLDLPLTTTSASVPTGTAANWRGRSIYQVVTDRFARTDGSITYSCDVTDRVYCGGSYRGIINMLDYIQGMGFTAIWISPIVENIPDDTGYGYAYHGYWMKDIFALNTNFGGADDLIALATELHNRGMYLMVDIVVNHFAFSGNHADVDYSEYFPYSSQDYFHSFCWITDYSNQTNVEECWLGDDSVPLVDVNTQLDTVKSEYQSWVKQLIANYSIDGLRIDTVKHVQMDFWAPFQEAAGIYTVGEVFDGDPSYTCPYQENLDGVLNYPVYYPVVSAFQRVGGSISSLVDMIDTLKSECIDTTLLGSFLENQDNPRFPSYTSDESLIKNAIAFTILSDGIPIIYYGQEQGLNGGNDPYNREALWPTGYSTTSTFYEYIASLNQIRNHAIYIDDTYLTYQNWVIYSDSTTIAMRKGFTGNQIITVLSNLGSSGSSYTLTLSNTGYTASSVVYEILTCTAVTVDLSGNLAVPMSGGLPRVFYPESQLVGSGICSM

SEQ ID NO: 1962 - DNA, 2851 bp, Aspergillus kawachii
gaattcatctcgcttcgccaagcgagacgccctaacgggtaacctgcagcttaccctgttcacccggcatatcacacgtcccgagaaatccgtcacgtcctccacgagtcagaacaaggttcggccgttgattcttctccattttgcgcgtatttagctaatggtcagtattccgtgtcggagatttgttgttctgcaacaattaaggggaccagggttaaatcctggcctccgaagtgatcggagttctgaccaatgagagactgtgtatactcccgttcctggctgatggattaattgccggcttcacttggcatccatcaagcatcagatgtgaccagaagggtaatgagtgggttgatctgccttgcaaggtgctcagccttctgcgaccatactgaagggaatatttaagagtggttatcagggacagagttcccatgtagtcaggctgtgtttgggatactttctgtcgcttcgtcagacattaatacggaactatgagagtgtcgacttcaagtattgcccttgctgtgtccctttttgggaagctggcccttgggctgtcagctgcagaatggcgcactcaatccatctacttccttttgacggatcggttcggtaggacggacaattcgactacagctacgtgcaatacgggtgaccaagtatggtattgctgtacttccgtcattcatctgctgacttggatagatctactgtggtggaagttggcaaggaattatcaaccatgttcgtatctcacttcataccatccatgctgggcgcttctgactattgctccagctggactatatccagggcatgggattcacagctatctggatctcgcctatcactgagcagctaccccaggatacttcggatggtgaagcctaccatggatactggcagcagaagatgtatgccctcatgcatcatattagctactcgcgacgcagcgactggcagatactatgtgaactccaacttcggcacggcagatgatctgaagtccctctccgatgctcttcacgcccgcggaatgtacctcatggtcgacgtcgtccctaaccacatggtaagtactgctttacctctatattagtaaacccaatgcgaacaatgactgtatcagggctacgcaggtaacggcaacgatgtggattacagcgtcttcgaccccttcgactcctcctcctacttccatccatactgcctcatcacagattgggacaacttgaccatggtccaagactgttgggagggtgacaccatcgtgtctctgccagatctgaacaccacggaaaccgccgtgagaaccatttggtacgattgggtagccgacctggtatccaactactcaggtgcgaccccaacccactaaaacaagccacatactaaaaaattgctcagtcgacggcctccgtatcgacagtgtcgaagaagtcgaacccgacttcttcccgggctaccaagaagcagcaggagtctactgcgtcggtgaagtcgacaacggcaaccctgctctcgactgcccataccaaaaatatctagatggtgttctcaactatcccatgtacatacccccttctaccttctcgaacccatcactaactcaattgctgcagctactggcaactcctctacgcctttgaatcctccagcggcagcatcagcaacctctacaacatgatcaaatccgtcgccagcgactgctccgatccgaccctcctgggcaactttatcgaaaaccacgacaacccccgcttcgcctcgtatgtcccttccatcactgcccccttttaaagtaaaccccactgacaggcaaagctacacatccgactactcccaagccaaaaacgtcctcagctacatcttcctctccgacggcatccccatcgtctacgccggcgaagaacagcactactccggcggcgacgtgccctacaaccgcgaagctacctggctatcaggctacgacacctccgcggagctctacacctggatagccaccacaaacgcgatccggaaactagctatctcagcagactcggactacattacttacaaggtttgccctttcccttccccccacccagagctcaacccccattctaacaaaatatttcaatggtagaacgacccaatctacacagacagcaacaccatcgcgatgcgcaaaggcacctccggctcccaaatcatcaccgtcctctccaacaaaggctcctccggaagcagctacaccctcaccctcagcggaagcggctacacgtccggcacgaagctcatcgaagcgtacacctgcacgtccgtgacggtggactcgaacggggatatccctgtgccgatggcttcgggattacctagagttctcctccctgcttcggtggttgatagttcttcgctttgtggggggagtggtaacacaaccacgaccacaactgctgctacctccacatccaaagccaccacctcctcttcttcttcttctgctgctgctactacttcttcatcatgcaccgcaacaagcaccaccctccccatcaccttcgaagaactcgtcaccactacctacggggaagaagtctacctcagcggatctatctcccagctcggagagtggcatacgagtgacgcggtgaagttgtccgcggatgattatacctcgagtaaccccgagtggtctgttactgtgtcgttgccggtggggacgaccttcgagtataagtttattaaggtcgatgagggtggaagtgtgacttgggaaagtgatccgaatagggagtatactgtgcctgaatgtgggagtgggagtggggagacggtggttgatacgtggaggtag

SEQ ID NO: 1963 - protein, 640 aa, Aspergillus kawachii
MRVSTSSIALAVSLFGKLALGLSAAEWRTQSIYFLLTDRFGRTDNSTTATCNTGDQIYCGGSWQGIINHLDYIQGMGFTAIWISPITEQLPQDTSDGEAYHGYWQQKIYYVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVEEVEPDFFPGYQEAAGVYCVGEVDNGNPALDCPYQKYLDGVLNYPIYWQLLYAFESSSGSISNLYNMIKSVASDCSDPTLLGNFIENHDNPRFASYTSDYSQAKNVLSYIFLSDGIPIVYAGEEQHYSGGDVPYNREATWLSGYDTSAELYTWIATTNAIRKLAISADSDYITYKNDPIYTDSNTIAMRKGTSGSQIITVLSNKGSSGSSYTLTLSGSGYTSGTKLIEAYTCTSVTVDSNGDIPVPMASGLPRVLLPASVVDSSSLCGGSGNTTTTTTAATSTSKATTSSSSSSAAATTSSSCTATSTTLPITFEELVTTTYGEEVYLSGSISQLGEWHTSDAVKLSADDYTSSNPEWSVTVSLPVGTTFEYKFIKVDEGGSVTWESDPNREYTVPECGSGSGETVVDTWR

SEQ ID NO: 1964 - DNA, 3411 bp, Aspergillus awamorii
gaattcaagctagatgctaagcgatattgcatggcaatatgtgttgatgcatgtgcttcttccttcagcttcccctcgtgcagatgaaggtttggctataaattgaagtggttggtcggggttccgtgaggggctgaagtgcttcctcccttttagacgcaactgagagcctgagcttcatccccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactgtatgtttcgagctcagatttagtatgagtgtgtcattgattgattgatgctgactggcgtgtcgtttgttgtagacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcaatggctgcttgtatgttctccacccccttgcgtctgatctgtgacatatgtagctgactggtcaggacaatggctacaccagcaccgcaacggacattgtttggcccctcgttaggaacgacctgtcgtatgtggctcaatactggaaccagacaggatatggtgtgtttgttttattttaaatttccaaagatgcgccagcagagctaacccgcgatcgcagatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggtaagtctacgctagacaagcgctcatgttgacagagggtgcgtactaacagaagtaggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatccggaaatacagacaccgtgaaagccatggtctttccttcgtgtagaagaccagacagacagtccctgatttaccctgcacaaagcactagaaaattagcattccatccttctctgcttgctctgctgatatcactgtcattcaatgcatagccatgagctcatcttagatccaagcacgtaattccatagccgaggtccacagtggagcagcaacattccccatcattgctttccccaggggcctcccaacgactaaatcaagagtatatctctaccgtccaatagatcgtcttcgcttcaaaatctttgacaattccaagagggtccccatccatcaaacccagttcaataatagccgagatgcatggtggagtcaattaggcagtattgctggaatgtcggggccagttccgggtggtcattggccgcctgtgatgccatctgccactaaatccgatcattgatccaccgcccacgagggcgtctttgctttttgcgcggcgtccaggttcaactctctctgcagctccagtccaacgctgactgactagtttacctactggtctgatcggctccatcagagctatggcgttatcccgtgccgttgctgcgcaatcgctatcttgatcgcaaccttgaactcactcttgttttaatagtgatcttggtgacggagtgtcggtgagtgacaaccaacatcgtgcaagggagattgatacggaattgtcgctcccatcatgatgttcttgccggctttgttggccctattcgtgggatcgatgccctcctgtgcagcagcaggtactgctggatgaggagccatcggtctctgcacgcaaacccaacttcctcttcattctcacggatgatcaggatctccggatgaattc

SEQ ID NO: 1965 - protein, 640 aa, Aspergillus awamorii; identical to SEQ ID NO: 1844

SEQ ID NO: 1966 - protein, 534 aa, Aspergillus awamorii; identical to SEQ ID NO: 1845

SEQ ID NO: 1967 - DNA, 1752 bp, Aspergillus clavatus
atgtcaccacatgcgctccgggaagtcccaacggggacgaacaactggtggaaggaggccaccgtctaccaggtctaccccgcgtctttcaaagactccaacggcgatggatggggcgatatccccggtctcatctccaaaatcccctatctgcattccctcggggtggacgtagtctggctgtcaccgcactatgactcgcccatgcacgacatgggctacgatatttccgactatgagaaggtcctccctgcctacgggacggtcgaggatgtcgaaaagctgatcgcggaatgccacgagcgcggcataaagctcattctcgacctggtagtcaaccacacgagcgacgagcacgcctggttcaaggagagccgcagcagcaaggacaacgagaaacgagactggtatttctggcgccccgcgcggtacgacgagcaagggaaccgacttccaccgacgaactatcggggttatttcgcggggagtacgtggacgtgggacgagaagacgcaggagtattacctgcatctgtatgcgaaggaacagcctgacttgaactgggataaccgagcgactcgggaagcgatatacgacagtgccgtgcgcttctggctggataagggtgtggacggattccgcgtcgacaccgtgaacaagtacagcaagcggacagatttccccgacgcgcgcgtcgttgatccgaagagctacatccagcctgcgatagagatgtggtgcaacggtccgcgcatccatgaatttatccgggagatgtacgacgaggcgctggcgccgtatggagatgtcatgaccgtcggcgagctggccaacaccccggacccgaaagacgtgctgaagtatgtgggcgcggcggcgcagcagctgagcatggtcttccatctggacatcggacatatcggcatgggaagcagcctggaggacaagtacatgttccagcagtggaaactgacccagatgaagagcattgtatccaagtggcagagctttgtcgagggcactgacggctggacgacggcattttgcgagaaccacgataacgggcggtccgtgtcccgattcgcgtctgatgcgcccgagttccgtgagcgctcggcgaagatgctggcgttgatgatggtcgccatgacggggacgttgttcctgtaccagggccaggagatcggcatgatcaatgcccccaaggactggccgatcgaggagtacaaggatatcgagggactgggatactacagggaggcggaacgacaagcagccagcggcacggacgtgacacgccctgaacggatcatggatgggttacgcattctggcgcgagatcattcccggttgcccatgcagtgggacgatacccccaatgccggattcacgactggcacgccgtggatgagaacccatgatttgtataaggagatcaatgtgaagaagcaagaagcggaccccgagagtgtactgtcgttctggaagacggcgttgcggctgcgcaaggaataccgagagctgttcatccacggcgcgtttgaggtcgtcgactttgagaatctcgaaacattcacttttgtcaagtcgagaggcgagaaacgcgccctggtagtgctgaacttcacctcgtcgacccaacccattacacaggctgctacagtgggagcgaagaagttgttgatcagcaactattcggaaacgacacctgataccctgcagccatttgaaggcaggatttacgtgtcatga

SEQ ID NO: 1968 - protein, 583 aa, Aspergillus clavatus
MSPHALREVPTGTNNWWKEATVYQVYPASFKDSNGDGWGDIPGLISKIPYLHSLGVDVVWLSPHYDSPMHDMGYDISDYEKVLPAYGTVEDVEKLIAECHERGIKLILDLVVNHTSDEHAWFKESRSSKDNEKRDWYFWRPARYDEQGNRLPPTNYRGYFAGSTWTWDEKTQEYYLHLYAKEQPDLNWDNRATREAIYDSAVRFWLDKGVDGFRVDTVNKYSKRTDFPDARVVDPKSYIQPAIEMWCNGPRIHEFIREMYDEALAPYGDVMTVGELANTPDPKDVLKYVGAAAQQLSMVFHLDIGHIGMGSSLEDKYMFQQWKLTQMKSIVSKWQSFVEGTDGWTTAFCENHDNGRSVSRFASDAPEFRERSAKMLALMMVAMTGTLFLYQGQEIGMINAPKDWPIEEYKDIEGLGYYREAERQAASGTDVTRPERIMDGLRILARDHSRLPMQWDDTPNAGFTTGTPWMRTHDLYKEINVKKQEADPESVLSFWKTALRLRKEYRELFIHGAFEVVDFENLETFTFVKSRGEKRALVVLNFTSSTQPITQAATVGAKKLLISNYSETTPDTLQPFEGRIYVS

SEQ ID NO: 1969 - DNA, 1761 bp, Aspergillus clavatus
atgtcccccgctcccatccaagagaagtggtggaagaactccatcatctatcagatctaccccgccagtttcaaggattccaacggcgatggcgtcggtgatatccccgggatcatctcccagctggactacatccagagtctcggcgtcgatgtagtgtggctgtgccccatgtacgacagcccccagattgacatgggctatgacatctccgactatgagagtgtatacgcgccctacggcacagtggaggacatggagcggttgatcgaagcctgtcatagtcgggggctgcgcatcatcctggacctcgtggtgaaccacacgtccgatcagcaccagtggttcaaggaatcgcggtcgtccaaggacagccccaagcgggattggtacatctggcgcccggccaagtacgatagcaatggcaaccgcaagccgcccaacaactggcgcgcggtgtttggcggcagtgcgtgggagtgggatgaaaccacccaggagtactatctgcatctgttctgtgtcgagcaacccgatatcaactgggagaacgcccaggtacggcaggccgtctatgcctccgccatggaattctggttgaagaagggggtggatggtttccgcgtggacaccgtcaacatgtacagcaaggaccccgccttctcggatgcccccatcctcaaccccaagtcggacacccagccggccttttcgctgttctgtaacgggccccggatccacgagtatctgtccgagatgtacgaggtgctcgacaagtacgacgccatgaccgtcggtgagctgccccagaccccgactctcgagggtgttctgcgctacgtgtccgcggagaagaagcagctcaacatggtcttctcctttgacgtggtcgatctgggcatgggcaaagattacaaattcctaaccaccccgcgcagctggaccctccccgagctcaaggaggccattgcgcgcgcccagaacatcctcaagggcactgatggctggaccaccgtgttcatggagaaccacgaccagggtcgctcgatttcgcggttcggatcggataagaccccggagctacgcgatgcgtcggccaggatgctcgccatgtttcagtgcaccctttcgggcacgcaattcgtctaccagggtcaggagatcgggatggtcaatgcgcccgaggagtggcccatcgaggaatacaaggatgtcgacagcacaaattattaccacatggtgcgcgaaatgagcaacaacgatcccgcccagctgaagaccgccatgcaggcgttgcagcatctggccagagaccactctcgcctcccgatgcagtggagcgccgacgctaacgccggcttctcctccccgacctccgagaaaccctggatgcgtccccacgacaactacaccgaaatcaacgtccaggcgcagcagaacgacccctcctccgtcctctccttctggaagaagatgatgcgtctccgcaaagaatattcggattcctttgtgtttggcattttcgagatgctggacgagcagaaccccaacgtcttcagctacctcaagcaatcgaaacggggtacgatgctggtggctctcaacttctccgacacgccacaaaagctcgagcaacgatcagaccttcagggccgggacctgaaactgctgctgagcacagctgctggcgaggcgtcggtaagcgaggagctgcggccattcgagggcaggatctaccaggtagccgccttgccgaattga

SEQ ID NO: 1970 - protein, 586 aa, Aspergillus clavatus
MSPAPIQEKWWKNSIIYQIYPASFKDSNGDGVGDIPGIISQLDYIQSLGVDVVWLCPMYDSPQIDMGYDISDYESVYAPYGTVEDMERLIEACHSRGLRIILDLVVNHTSDQHQWFKESRSSKDSPKRDWYIWRPAKYDSNGNRKPPNNWRAVFGGSAWEWDETTQEYYLHLFCVEQPDINWENAQVRQAVYASAMEFWLKKGVDGFRVDTVNMYSKDPAFSDAPILNPKSDTQPAFSLFCNGPRIHEYLSEMYEVLDKYDAMTVGELPQTPTLEGVLRYVSAEKKQLNMVFSFDVVDLGMGKDYKFLTTPRSWTLPELKEAIARAQNILKGTDGWTTVFMENHDQGRSISRFGSDKTPELRDASARMLAMFQCTLSGTQFVYQGQEIGMVNAPEEWPIEEYKDVDSTNYYHMVREMSNNDPAQLKTAMQALQHLARDHSRLPMQWSADANAGFSSPTSEKPWMRPHDNYTEINVQAQQNDPSSVLSFWKKMMRLRKEYSDSFVFGIFEMLDEQNPNVFSYLKQSKRGTMLVALNFSDTPQKLEQRSDLQGRDLKLLLSTAAGEASVSEELRPFEGRIYQVAALPN

SEQ ID NO: 1971 - DNA, 5739 bp, Aspergillus oryzae
ggtacctcttactgaccagcacttggtatattgacttttgttgctaatgtgttctgcccaggttgggatgagggtgtcatgcagatgagcctcggcgagaagtctaccctgactattaccccgtaagttaaccctctgcgggaatggaaattagcttaatactgaccatattatgtagggactatggctatggtgacaagtatgaaccctgaacatatatagtcaatgacttacacatgttggattgaacctattctaaccatcttctttatagggccgctggcaagatccctgcaaactctactctgatcttgtaagttgcaaagtcatttaatttggaaatagtgttgtgggattaactgtctattacagcgaggttgagcttcttaagattaactagtggcatcgcattatcaagtgatcaaatagtggctatagagaggcggccccgatttcaatgacttttgcctgtttcggtacttgctacagggaaacaccaggttgcatagtatattgcagagctctaggaacttaaaagatctgcttagatggaactcaaagcatccactcctcaatagactattacacctcttagatctatacggggataatcccggccgcttgtgggaagtatcaatttcaatggtgtagccatgcgaataatacaacaatagcatccatgtgcaactacgaatcattccaaacgaaatacatcgaaaagatctaattcgaaaaccacagctgtattgctatactaaatcaactcgtcaattgtccttcatggtttaagcaagatacattataagtccaagagacctttcaagtcccacaagttattttcccagtcaattcgaaccggaacaagatacagacatcagagaagttaaaagcacaacggatagaataacacaaactcccaacgcaagaacacctcttgctccttattacatgaatcgtccaagttcaaattcaaaccttcaccatatcatccttcccctcgccctgcaaatcctccaacccagtcttagcagtcgcaaactccctcgtcttcacccctctctcaaacaacagatccaactcagcatacgaccgtcccttaggttctggcagccggaagaacgaccacgtcaagcagcaaacgcagagtgcaccccagaagaaacctgatttaccgcgccagttccatgcgtcgacgttcagcatatacgggataatgattccggtgacgaggttgaggatattgtagacgtttcgggccagcacgacggtcttggtacggagtctggaggatgggatttcggagacgagggcgaagcagacggggccgatggaggagtcgtagataaaggtatagacgagaagcatggagccggtggcccaggagatggcgggtgtggatggagcgatggagacgaacccgatgacgaataatacgatggctaggataaatagaccgccgacgtagagggtgcgacggccgaagtacgacattagtgtccaggagacgaatgtccccaccacgcctagggcatattgcacgagcgacatggtgaaggactgcgacacggcgagacctgcgcgctggtaaaagacagtcgaatagcccatgaggcctgcgccacatagactctgcgccgcccatgcgcagcaggagatttcggttcggcgtaagtcgcttttcttgaagcagtcaaggtaggaggtaccggtttcagcacgtcgctcgagtgcgtcggtgtatacgatcattgcgacggtttcttcggcgttgaagtctgcgttagcgctggtcagtcgtttcaatgccttgacggcatcttcgcggcggtcttgtcgaacgagccaccaggggctctcgggggccagaaacaccccgatgaaaatgggaattggccagatccactgcagagcaaaggggatacggtatgcccattgatcggtgcgctcggccagacccttcagcacgccagaggcgagcaattgacctagcacccagcaaaggttaacataggtggtgagatatgcgcgcaatgcgacagggcacacttcggatgcgtatgtcacaacgagggtttggtatacaccaagagggatgcccataaagagctcgccgacaacgagagtttgaatattgggcgcaaagaacagaatgaaaacgaaaccaacggtcgcggcaaggcatgccatcagggtctttcggtatcccaagcgctctgagaccagtccattgagaaaaagtccgataatctggccgcaggccatcgcgttgttaacacctgcttgccacctagcttcgagcccatatgtcccgtcggacatgagacctccgtatttttcgttgaaggcaggaaatgcgaggaaggaaccgataagaacaacatcgtagccttccatgataatggcacaggagaacagaagagaccacgccaccgccttcggataaagtcttagcgcttgccatagagtcatctcacgttctttcgcaatggcggtatgtgcctcgctactgttggggaggtcgatatcatcatgcctcgctgggttatcgttttcaatatgttcagacatagcggccttctctggagtcatcttgggtgcggtatgcaatagaccgagctggagcaatagcggatgcagtggacgattgcgtggaaagtgaaggcacatacaggccctttatagaagcttgcagcaggaatcagaccacaatcaatggcgcttcatatgcacctaacctggactatacgagcatctaagttccccgagtctgcgtgattccccgcagcatcctcagcagaatgcaggtgctgtccaggagacaaggtttttccccagattctctctagcggatccccccggatttttgacggccgaatggagcggtttgattggccgaatgtcgggccgagaagaatcaaaaggcaatcgaagaattgacttctgtgataatttatgcttgttttcaacccagaaccaatttgacggagactcaagccaaattatttgttccattcattccataccaataccaactccgagtcggatacataacactgaggtgtattcttgtaaacatccaccactgtaaaagtcaaatgatgggtccgatgtgttaggaaacccttagatagggggggggggggggacttaagcaggggcaaaggtgggccaagctcttgatctagggtcaactcaatcacatggagttgtccagacccctgctgctcggctcgcagtcctcgacctcctattggtctgatgtcggcccgcgccacatattaatgaggagaaccctaactctctaacgccactaactgcggccgacttagtcggttgcttggccattttatctgatacgaaatccgctgcatgcacatgtgcataatatggtcactgtgcccatgggagaaatgtaacatttggaaccatcttgacaacggtcaagtggggtatggtcttgtggggttggagctggagcctgatcgaaatcgcatgggcctcttatgcaggagcgatatcttctcgggccgacattgcgccaatcaagagtctctatcgtatggatcaacatcgtacatgccagttgttatgggagggtgtgcatgggagggtgtccgagtaccgtgactttactactcaccaaggcagttatatatctttccctccgaccaagttgattttgccagaaagcctttcctcctctaccctcctcccttcatctcctatacctcatagtcctccaagatgtctccagccccagttggtgaaaaatggtggaaaaactccatcatctaccagatctacccagccagttttaaagactccaacaatgacggcatcggcgatatccccggtattatctcctcccttgactatatcaccagcctgggggtagacgtaatttggatctccccaatgtatgacagtccccagtacgacatggggtatgatgtctccgattatgagagcgtctacccaccatacggcacagtccaggacatggaagttctcatcgacgagtgccaccgtcgtgggctgcgcattattctggacctagtcgtcaatcacacctcgcacgagcacaagtggttcaaggaatcgcgatcatcaaaagcaagccccaagcgggattggtatatctggaagcctgcaaaatacgacgccaatggaaaccggaagccacccaacaactggcgcagtatcttcggcggcagtgcttgggaatgggacgaaggaagcgaagaatattatctccatttgttttgcaaggagcagccagacctcaactgggagaaccaagagacccgtcgtgcgatctacgactcggcgatggagttttggctgcagaagggtgtcgatggattccgtgtggacacggtcaacatgtacagcaagcaccctgagtacccggatgcgcctgttatcgatcccaagtcggagactcaaatgtcgccggcattgttctgtaatggacctcgtattcatgaatacctcagtgagatgaacgaggtgcttgcgaagtatgacgctatgacggtgggagagctgccgaacacgcacactgtcgatggcattctgcggtatgtgtcagcggcgcagaaccagctcaacatggtctttcagttcgatatcgtcgatctcggacaaggaaaggattataaattcttgactacgctgccgggctggaccctgccggaactcaagaccgctgtcaagggtactcaagttatcatgaaggggacagacggttggtccacggtcttcacggagaaccacgaccagggtcggtccgtctctcgctttggttccgagaagaccccagaattgagagtcacctcggcgaagatgcttgcaatgatgcagggcacgttgtcaggcactcaattcatctaccaaggccaggaaattggcatggtcaatgcgccagagagctggaccatcgacgaatataaagacgtcgacagcacaaactactaccaaatggtgcagaagatttccaataacgacccgctggagctggagactgcgatgaagtcactccagcgtttcgcgagagaccatgcccggcttcccatgcagtggagctctgagactcatggtggattctcctcctcagaaaagacatggatgcgtgtccatgataactaccccgagataaacgtaaaagtgcaggagaaggatgactcttccgtcttgtcgttctggaaacaagttattcaactgcgtaaagagtacgccgacctgttcgtctttggggatttcgagatcttggacgaggcaaatgagaaggtgttcacctatatcaagcgagggcagaagcaatcggccttgatcgtattaaacttctcggacgatacactgaaattcaagcaaccagctggggtgcaagatgccaaggtgttgctgcgtaacgttgaaggggatttgaacgagttgcagccatttgagggacgtgtgcttctattttagttgatagagataatgactctggtagtactttagactgaataaatggttcttcgctcgatgggaatataaaaagaaattgaaaatagcccaagtatatgagtgcctcaggccaccgccaaggcgctaaggcacgctatccaatataaatctggggtaagagaggcggggcccacgatgtctcctcttaccgacatcgcaagctagatcgatgcatatcgtcgccgtagaaccatggaggaccaccctcgacctcgagtacacaaggcatgc

SEQ ID NO: 1972 - protein, 539 aa, Aspergillus oryzae
MTPEKAAMSEHIENDNPARHDDIDLPNSSEAHTAIAKEREMTLWQALRLYPKAVAWSLLFSCAIIMEGYDVVLIGSFLAFPAFNEKYGGLMSDGTYGLEARWQAGVNNAMACGQIIGLFLNGLVSERLGYRKTLMACLAATVGFVFILFFAPNIQTLVVGELFMGIPLGVYQTLVVTYASEVCPVALRAYLTTYVNLCWVLGQLLASGVLKGLAERTDQWAYRIPFALQWIWPIPIFIGVFLAPESPWWLVRQDRREDAVKALKRLTSANADFNAEETVAMIVYTDALERRAETGTSYLDCFKKSDLRRTEISCCAWAAQSLCGAGLMGYSTVFYQRAGLAVSQSFTMSLVQYALGVVGTFVSWTLMSYFGRRTLYVGGLFILAIVLFVIGFVSIAPSTPAISWATGSMLLVYTFIYDSSIGPVCFALVSEIPSSRLRTKTVVLARNVYNILNLVTGIIIPYMLNVDAWNWRGKSGFFWGALCVCCLTWSFFRLPEPKGRSYAELDLLFERGVKTREFATAKTGLEDLQGEGKDDMVKV

SEQ ID NO: 1973 - protein, 574 aa, Aspergillus oryzae
MSPAPVGEKWWKNSIIYQIYPASFKDSNNDGIGDIPGIISSLDYITSLGVDVIWISPMYDSPQYDMGYDVSDYESVYPPYGTVQDMEVLIDECHRRGLRIILDLVVNHTSHEHKWFKESRSSKASPKRDWYIWKPAKYDANGNRKPPNNWRSIFGGSAWEWDEGSEEYYLHLFCKEQPDLNWENQETRRAIYDSAMEFWLQKGVDGFRVDTVNMYSKHPEYPDAPVIDPKSETQMSPALFCNGPRIHEYLSEMNEVLAKYDAMTVGELPNTHTVDGILRYVSAAQNQLNMVFQFDIVDLGQGKDYKFLTTLPGWTLPELKTAVKGTQVIMKGTDGWSTVFTENHDQGRSVSRFGSEKTPELRVTSAKMLAMMQGTLSGTQFIYQGQEIGMVNAPESWTIDEYKDVDSTNYYQMVQKISNNDPLELETAMKSLQRFARDHARLPMQWSSETHGGFSSSEKTWMRVHDNYPEINVKVQEKDDSSVLSFWKQVIQLRKEYADLFVFGDFEILDEANEKVFTYIKRGQKQSALIVLNFSDDTLKFKQPAGVQDAKVLLRNVEGDLNELQPFEGRVLLF

SEQ ID NO: 1974 - DNA, 1767 bp, BACILLUS SP. ZW2531-1
atggaatatgcagcgattcaccaccagccattcagcacagatgcttattcttataatgggcggactgtgcatatcaagattcggacgaaaaaaggtgatgcagatcacattcgattcatttggggtgatccccatgagtacaacgacggcaagtggtcggcaaacgagcagccgatgagaaaaattgctgcaacagaaatgcatgactattggtttgctgaagtggtgccgccatttaggcgtttacaatatgcgtttgttgtaacagacgatcatgaagacatctttttcggaagttcgggtgtatgcccttataacgaaaaaacactggaaacgattcattattactttaaatttccgtttgttcacgaggctgatacatttcaagcgcctgaatgggtcaagtcaacggtttggtatcaaatttttccggagcgttttgcaaatggaagagaagacttgtcaccgaagaatgcattgccgtgggggagcaaggacccgggcgtcaatgatttttttggaggagatttgcaagggattgttgacaagcttgattatttagaggatttaggggtgaacggcatttatctgacgccgatcttttccgcgccttctaatcataaatacgacacgctggattacttttctattgatccgcatttcggggatcctgagctttttcgtacattggtcagccagctgcatcagcgggggatgagaattatgcttgatgcggtttttaaccatataggaagcgcgtctccgcaatggctggatgtcgtcaaaaacggagatcaatcccgctataaggactggttccatattcactcttttcccgtcacaggcgacaattatgacaggtttgcttttacagctgatatgccgaagctaaacacggctaatcccgaagtgcagaaatatttgcttgatattgctttgtactggattcgcgaatttgacattgacggctggcgtttggatgtcgcaaatgaagtggatcacgtgttttggaagacatttaggcaggctgtatctactgaaaagcctgacgtttatattttaggtgagatctggcattctgccgaaccctggcttagaggggatgaatttcatgcggcgatgaattacccttttacagagcctatgattgaatattttgctgaccggacgatcccagcctcacgtatggcctaccgtgtcaatgcacatttgatgaatggaatgaagcaggccaatgaggtgatgtttaatttactggatagccatgatacaaagcgccttttgaccagatgccgcaatgatgagaagaaagcacgcgcgttgctggcctttatgtttgcccagacaggctcaccatgcatttattacggaacggaaatcgggctgaacggcgaaaatgatccattatgccgggaatgtatggtttgggaaaaagagaagcaaaaccaagacatgctgcaatttatgaaacggttaattgctttacgcaagcaggaaaacactttattgacagaaggaaatcttgagtggaatctgctggatgaccaaaacgattttattagcttttcacggactcttgatgaaaaaatactgatttatttctttaatcaagggaatgcggttcaatatgtcagcttacgagatttgaatattgaaaggaataagaaaatctgtgatgcatggacagagcagccgcttcagcatcacgatgtcattgccgttcagccgggagaatttttgattttgagtgctgccgcccctgtataa

SEQ ID NO: 1975 - protein, 588 aa, BACILLUS SP. ZW2531-1
MEYAAIHHQPFSTDAYSYNGRTVHIKIRTKKGDADHIRFIWGDPHEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPGVNDFFGGDLQGIVDKLDYLEDLGVNGIYLTPIFSAPSNHKYDTLDYFSIDPHFGDPELFRTLVSQLHQRGMRIMLDAVFNHIGSASPQWLDVVKNGDQSRYKDWFHIHSFPVTGDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADRTIPASRMAYRVNAHLMNGMKQANEVMFNLLDSHDTKRLLTRCRNDEKKARALLAFMFAQTGSPCIYYGTEIGLNGENDPLCRECMVWEKEKQNQDMLQFMKRLIALRKQENTLLTEGNLEWNLLDDQNDFISFSRTLDEKILIYFFNQGNAVQYVSLRDLNIERNKKICDAWTEQPLQHHDVIAVQPGEFLILSAAAPV

SEQ ID NO: 1976 - DNA, 2726 bp, GEOBACILLUS STEAROTHERMOPHILUS
aattccggcccaacgatggctgatttccgggttgacggccggcggaaccaaggggtgatcggtcggcggaaatgaaggcctgcggcgagtgcgggccttctgttttgaggattataatcagagtatattgaaagtttcgcgatcttttcgtataattgttttaggcatagtgcaatcgattgcattacgaaaggagacacacatgcaatgaaaaagaaaacgctttctttatttgtgggactgatgctcctcatcggtcttctgttcagcggttctcttccgtacaatccaaacgccgctgaagccagcagttccgcaagcgtcaaaggggacgtgatttaccagattatcattgaccggttttacgatggggacacgacgaacaacaatcctgccaaaagttatggactttacgatcctaccaaatcgaagtggaaaatgtattggggcggggatctggagggggttcgtcaaaaacttccttatcttaaacagctgggcgtaacgacaatctggttgtccccggttttgaacaatctggatacactggcgggcaccgataacacgggctatcacggatactggacgcgcgattttaaacagattgaggaacatttcgggaattggaccacatttgacacgttggtcaatgatgctcaccaaaacggaatcaaggtgattgtcgactttgtgcccaatcattcgactccttttaaggcaaacgattccacctttgcggaaggcggcgccctctacaacaatggaacctatatgggcaattattttgatgacgcaacaaaagggtacttccaccataatggggacatcagcaactgggacgaccggtacgaggcgcaatggaaaaacttcacggatccagccggtttctcgcttgccgatttgtcgcaggaaaatggcacgattgctcaatacctgaccgatgcggcggttcaattggtagcacatggtttgcggattgatgcggtgaagcattttaattcggggttctccaaatcgttggccgataaactgtaccaaaagaaagacattttcctggtgggggaatggtacggagatgaccccggaacagccaatcatctggaaaaggtccggtacgccaacaacagcggtgtcaatgtgctggattttgatctcaacacggtgattcgaaatgtgttcggcacatttacgcaaacgatgtacgatcttaacaatatggtgaaccaaacggggaacgagtacaaatacaaagaaaatctaatcacatttatcgataaccatgatatgtcaagatttctttcggtaaattcgaagaacaaggcgaatttgcaccagcgcttgctttcattctcacttcgcggggtacgccctcccatctattatggaaccgaacaatacatggcaggcggcaatgacccgtacaaccgggggatgatgccggcgtttgatacgacaaccaccgcctttaaagaggtgtcaactctggcggggttgcgcaggaacaatgcggcgatccagtacggcaccaccacccagcgctggatcaacaatgatgtttacatttatgaacggaaatttttcaacgatgtcgtgttggtggccatcaatcgaaacacgcaatcctcctattcgatttccggtttgcagacggccttgccaaatggcagctatgcggattatctgtcagggctgttgggggggaacgggatttccgtttccaatggaagtgtcgcttcgttcacgcttgcgcctggagccgtgtctgtttggcagtacagcacatccgcttcagcgccgcaaatcggatcggttgctccaaatatggggattccgggtaatgtggtcacgatcgacgggaaaggttttgggacgacgcagggaaccgtgacatttggcggagtgacagcgactgtgaaatcctggacatccaatcggattgaagtgtacgttcccaacatggccgccgggctgaccgatgtgaaagtcaccgcgggtggagtttccagcaatctgtattcttacaatattttgagtggaacgcagacatcggttgtgtttactgtgaaaagtgcgcctccgaccaacctaggggataagatttacctgacgggcaacataccggaattggggaattggagcacggatacgagcggagccgttaacaatgcgcaagggcccctgctcgcgcccaattatccggattggttttatgtattcagcgttccagcaggaaagacgattcaattcaagttcttcatcaagcgtgcggatggaacgattcaatgggagaatggttcgaaccacgtggccacaactcccacgggtgcaaccggtaacattactgttacgtggcaaaactagaaatctttttcgaaaaaaggccgccccgttaagaggcggccttcttcaaatttcaggatatgcacttgcttgccgcaccccggcatggaatctgaggaaaaccaaagaaacggcgaagaattggaacgtcaaagaaatggataggcggacgcccgaattttttgatatgctaaaaaataattgcgcaagggggagtagtacatatggaaaaccgtctgtacatcaacggagaatggcgggaactgctgaacggcggcaatttccggtggtggtcaatccggcgaccgggctagtgatccagttgctcaaaaaaatctcggtcagatgttactagcaactcatttacaagaacagcatctttcctc

SEQ ID NO: 1977 - protein, 717 aa, GEOBACILLUS STEAROTHERMOPHILUS
MKKKTLSLFVGLMLLIGLLFSGSLPYNPNAAEASSSASVKGDVIYQIIIDRFYDGDTTNNNPAKSYGLYDPTKSKWKMYWGGDLEGVRQKLPYLKQLGVTTIWLSPVLNNLDTLAGTDNTGYHGYWTRDFKQIEEHFGNWTTFDTLVNDAHQNGIKVIVDFVPNHSTPFKANDSTFAEGGALYNNGTYMGNYFDDATKGYFHHNGDISNWDDRYEAQWKNFTDPAGFSLADLSQENGTIAQYLTDAAVQLVAHGLRIDAVKHFNSGFSKSLADKLYQKKDIFLVGEWYGDDPGTANHLEKVRYANNSGVNVLDFDLNTVIRNVFGTFTQTMYDLNNMVNQTGNEYKYKENLITFIDNHDMSRFLSVNSKNKANLHQRLLSFSLRGVRPPIYYGTEQYMAGGNDPYNRGMMPAFDTTTTAFKEVSTLAGLRRNNAAIQYGTTTQRWINNDVYIYERKFFNDVVLVAINRNTQSSYSISGLQTALPNGSYADYLSGLLGGNGISVSNGSVASFTLAPGAVSVWQYSTSASAPQIGSVAPNMGIPGNVVTIDGKGFGTTQGTVTFGGVTATVKSWTSNRIEVYVPNMAAGLTDVKVTAGGVSSNLYSYNILSGTQTSVVFTVKSAPPTNLGDKIYLTGNIPELGNWSTDTSGAVNNAQGPLLAPNYPDWFYVFSVPAGKTIQFKFFIKRADGTIQWENGSNHVATTPTGATGNITVTWQN

SEQ ID NO: 1978 - DNA, 3258 bp, BACILLUS SP. US149; identical to SEQ ID NO: 1795

SEQ ID NO: 1979 - protein, 582 aa, BACILLUS SP. US149; identical to SEQ ID NO: 1796

SEQ ID NO: 1980 - DNA, 4499 bp, Bacillus acidopullulyticus
gatctttatagaagtcggtaagggaatagccatacaatttttctatacctgttgtaatcagcagggaatcattttttaaatcatgagaccaaatcgcgacatcaagagtgtcaaaaatattttttaatttcagcttgctttgacgaagctcctcattggtctttctcattttgttaaaggttaaaaacagaatatacaaaaatgccaataatacaacaatcgagatatagttgatcattttaaatgaggaaaaccataccgggctgattaaggttgtgaaaatgattaagaaaataagcatccagcttaacatatattttacgttcttgcccttcatccgtactgtctccctttatgaaaatagtcttgggtatatttaattatcttcatgtttgatactttaaaaatatcaaaaaaactttcatttcacaatattcataaagacggcgttcccaatatttctctgccttttgattaatatatccattagctgtaaaactatcatcttaaaacactcattttttgggtatataacctgcatacaatccaattgaaggagtaaagaaaaaatgtttagagaagcaatttatcaccgtcctaaagataattatgcatatgcttgcgcaaatggagaattacatatcagaatcagaacgaaaaaagacgatatgaaagaggtaacacttgtttacggagacacttatgaatttgatgacaataaatggacctattcaacagcccatatgaaaaaaaccggctccgaccaattgtttgattactggctcgcttctgtcactccgcgatataagagattgcgctatgggtttattgtaaatgaccgcaaagactcgacctgttttactgaaaaagggttttacccggagcccccagtaaatgacatttcctattatttcagctttccttatgtgaatcaggccgatattttccaggcacccgaatgggtaaaggacaccgtctggtatcaaattttccctgaacgctttgccaatggaaacaaagacaacgaccctgatggcacccttccatggggcagccgtgaaccggaaattgacaacttttttggcggagatttggaaggagtcattgaacatattgactatctcaaagaattgggcattggcggtatatactttacccctatatttaaggcacactccaaccataaatacgatacgattgattacatggaaatagatccgcaattcgggacaaaagaaacattaaaaaaattgattgatgtctgccataaaaatggaataaaagtgatgcttgatgctgtgtttaatcatagcggtgttttttttccaccatttcaggatgtagtggaaaaaggtaagaattccaagtaccaagactggttccacatccgggagtttccactcgtaatggagccaaggccaaattatgataccttcggctttacgtcttccatgccaaagttcaagacagaaaaccctgaagtgaaggaatatttactagaggttggccggtattgggtaagggaatttgatattgacggctggcgtttagatgtggcaaatgaagtgagccacgccttttggcgtgaattccgcagggaagtgaaagccatcaagcccgacttgtatatccttggggaaatttggcacgactccttgccttggctgcggggtgatcaatttgatgctgtgatgaattatcctttatccactaatattgtaaatctttttgccaatcaatccgtttcggtaaaagagtttgtagaaaatatgtcccatgttatccatatgtatcctgacactgttaacgaagctgcgttcaaccttgttggcagccacgatacaccgagaatattaacacagtgcggagaggatgtagaacgcttaaagcaagtgtttgtcttattgttaacattcataggcaccccctgcatttattacggggatgaaatcggcttaaccggcggacaggatcccggctgccggaaatgcatggagtggaatccagaccaacaaaaccgtgaacttcttcagcacgtcaggaaattaatacaattacgcagcgaaaatcctttgctcgccaatgagggagagctgacttttgtcccaccgaaaaatgaggaagatccgtgtcttgcttatacaaaatccaatgaggaaaaaacgattatgattattataaataaaagtaaaaactcagtggagtacccactttcatttgacgcagctgaacaaacagtaaaaaatctttggaatcaggaacagttgattttacaaaatggccaaacactggaactgaaggcaaatgactttaaaatattagaattttaaagaaaaaaggctggatctgatacaagatccagcttttattagaaatttagttttttaatctgcctctttttttagtagaataggaaattttctattataagtcatcattctccatacccactccagagggccaaatttacagtatttcaaccacatcgcactaaaaataagctgaataacataaatagccaagcataaccaaagggattgaagataggttatgcgattgaataaatgaaatagttttcctgccagcaaaatcagagccgtttgtgagatataattggttaaagccattcttccatagcttttcaaaggtgataacagccgccgtgcaataggagcctgcaaaagcagcaagaggaaacctgcataaaaggccgacagaattggacctgttgcaactcccagatgcagaaaccattttaattgatccatattttgatagtttttctccaggccattaagattattaaaaggttgctctggaacgtaacaatattgcaaaaggagtccgcccacactgagtataaacataaagaatgtgaaaatagctgtttcagttttataacgagccagcttttcaaaaatccgatattggcccgcagacagtcccagtaaaattagcggcaaaggcatgaagatttttgcagcaaaaatggatacaaacagtaagaggatacatcccgtaaaaaggttcacttctttttttatcttgtaaaacggcaacatgagaagtccgcagctcgcatagaccgttaacgcctctcctggctggaacaagaaatgaataaatccgaaaataaataagaccaggattctccgtaaaaacaaaatggctccattttctccccttgtattggctcttgcgataaataaataaaaccccacaccaaacaaaaaagagaaaataggataaaaacgtgcttcgacaaaaaaatataaaaaccgttgataaaccgcatctactgagtgcagggcgggggttttaacagtgagcaatccaagaatattcacaagaataattccaagcagtgcaaatcccctcaaataatcaagagtaccaattctttcatctaaggcgatgggatccatcaaaataccctcttccctaaaaagcacagtacatttttttatgctcaaatggatgaatcgggttcaataaatcagttaccctgttccaggagccatctgttatttgtgcatacattattggtcttcagagatttttgattttttatttcttccgatttgcttccatgcaagcacgaccgctaacgtcacaatggtacctacaacggcttcaggaaggccgttcgtaatggcaaccgtccaggccacacctgctgttaagtagtgccggaatacagccatggccagaacaagtgcagtatttgttaatgttcctataaaggcagaaaggccaaccgctacgtattcacttttccggcggataccaatgtaaacaagccaagccaccacgccaataaacaaacgcgggagaatggaaaccaaaggatccttaaataatggaacggttgcatttaaaaaagacgagataccaaaaattgctcccacaattaatccgacaacaggaccttgcataattcctccaataatagccgggatatgcataatagttgcatttcctgctgcagttggaacaggaatatatcctaatcgtgttacaccaagaagaatcgccacggcaccaagtacgcccgcaatcacaatatcacgaaccgttaatgactttttcaatcttcttcccccttttcttttgtaaaaacaaataaaaaaatagataaaatgacgttttaatttagtaaggaaacggataaaacagtaataaaacagagaataagagtccgatcaaaagggccgcataatctttggcaagctgctttatagacagtaaaggtgctccggtcatttccaggtgtatagcagcgggattccatagccaaaatcaaatcttcagctctggataaggcaatattaaataacgggataataattggaaacatatcccttgttctttggatgattctccaccagcttcccgaaccaaaatctgctccccgggatgcctgggctttcatcattttttccatttccatcgcaaaggttggcacaaagcgaatcgcaatggtggtaatgagtgagatc

SEQ ID NO: 1981 - protein, 586 aa, Bacillus acidopullulyticus
MFREAIYHRPKDNYAYACANGELHIRIRTKKDDMKEVTLVYGDTYEFDDNKWTYSTAHMKKTGSDQLFDYWLASVTPRYKRLRYGFIVNDRKDSTCFTEKGFYPEPPVNDISYYFSFPYVNQADIFQAPEWVKDTVWYQIFPERFANGNKDNDPDGTLPWGSREPEIDNFFGGDLEGVIEHIDYLKELGIGGIYFTPIFKAHSNHKYDTIDYMEIDPQFGTKETLKKLIDVCHKNGIKVMLDAVFNHSGVFFPPFQDVVEKGKNSKYQDWFHIREFPLVMEPRPNYDTFGFTSSMPKFKTENPEVKEYLLEVGRYWVREFDIDGWRLDVANEVSHAFWREFRREVKAIKPDLYILGEIWHDSLPWLRGDQFDAVMNYPLSTNIVNLFANQSVSVKEFVENMSHVIHMYPDTVNEAAFNLVGSHDTPRILTQCGEDVERLKQVFVLLLTFIGTPCIYYGDEIGLTGGQDPGCRKCMEWNPDQQNRELLQHVRKLIQLRSENPLLANEGELTFVPPKNEEDPCLAYTKSNEEKTIMIIINKSKNSVEYPLSFDAAEQTVKNLWNQEQLILQNGQTLELKANDFKILEF

SEQ ID NO: 1982 - protein, 346 aa, Bacillus acidopullulyticus
MDPIALDERIGTLDYLRGFALLGIILVNILGLLTVKTPALHSVDAVYQRFLYFFVEARFYPIFSFLFGVGFYLFIARANTRGENGAILFLRRILVLFIFGFIHFLFQPGEALTVYASCGLLMLPFYKIKKEVNLFTGCILLLFVSIFAAKIFMPLPLILLGLSAGQYRIFEKLARYKTETAIFTFFMFILSVGGLLLQYCYVPEQPFNNLNGLEKNYQNMDQLKWFLHLGVATGPILSAFYAGFLLLLLQAPIARRLLSPLKSYGRMALTNYISQTALILLAGKLFHLFNRITYLQSLWLCLAIYVIQLIFSAMWLKYCKFGPLEWVWRMMTYNRKFPILLKKEAD

SEQ ID NO: 1983 - protein, 183 aa, Bacillus acidopullulyticus
MKKSLTVRDIVIAGVLGAVAILLGVTRLGYIPVPTAAGNATIMHIPAIIGGIMQGPVVGLIVGAIFGISSFLNATVPLFKDPLVSILPRLFIGVVAWLVYIGIRRKSEYVAVGLSAFIGTLTNTALVLAMAVFRHYLTAGVAWTVAITNGLPEAVVGTIVTLAVVLAWKQIGRNKKSKISEDQ

SEQ ID NO: 1984 - DNA, 2471 bp, Bacillus licheniformis; identical to SEQ ID NO: 1748

SEQ ID NO: 1985 - protein, 578 aa, Bacillus licheniformis; identical to SEQ ID NO: 1749

SEQ ID NO: 1986 - DNA, 1767 bp, BACILLUS SP. WPD616
atgaggaaagaagccatccaccaccgctcaaccgacaatttcgcttacgcttatgacagcgagacgctccatctccggcttcaaacaaagaaaaatgatgtcgaccacgtcgagctgctttttggcgacccgtacgaatggcacgatggcgcctggcagtttcaaacgatgccgatgcggaaaacggggagcgacgggttgtttgactattggctcgccgaagtcaaaccgccatatcgacggctgcgctatgggtttgtgcttcgagctgggggcgagaaactggtctatacggaaaaaggattttaccatgaagctccgagcgacgacaccgcttactacttttgcttcccctttcttcatcgggtcgacctattccaagcgccggactgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggtattaccggcatttacttgacgccgattttccgcgcaccgtcgaatcataaatacgacaccgctgattattttgaaatcgacccgcactttggggacaaagagacattgaaaacacttgtcaaacgctgccatgaaaaaggaatccgcgtcatgctcgatgcggtcttcaatcattgcggctatgagtttggcccgtttcaagatgtgttaaaaaacggcgcagcgtctaggtataaagattggttccatattcgcgagtttccgctccaaacggagccgcgcccgaattacgacacgtttgcgttcgtgccgcaaatgcccaaactcaataccgcccatccggaagtgaagcgctacttgcttgatgtcgcgacgtactggattcgcgagtttgatattgacggctggcggctcgatgtggcaaacgaaatcgatcaccaattttggcgcgaattccgtcaggcggtgaaggcgctaaagcccgatgtgtacattctcggcgagatttggcatgatgccatgccttggctgcgcggcgaccagtttgacgccgtcatgaactaccagttggcggacgcggcgctccgctttttcgccaaagaagacatgagcgccagcgagtttgccgaccgattgatgcatgtgcttcattcctatccaaaacaggtcaacgaagcggcattcaacttgcttggcagccatgatacaccaaggctgctcactgtttgcggcggcgacgtccgcaaagtgaagttgttgtttttgttccagctcacgttcactggttcgccgtgtatttactatggcgatgagatcggcatgacgggtggaaacgatccggaatgccggaaatgtatggtgtgggatccagagaagcaaaacaaagaactgtatgaacatgttaagcaactgatcgctcttcgcaagcaatatcgggcgcttcgacgcggcgatgtcgcttttctcgccgccgatgatgaagtgaaccatcttgtttatgcaaaaacggatggcaatgaaacggtcatgatcatcatcaaccggagcaacgaagcagcagaaattcccatgccgatcgatgcgcgtggaaaatggctggtcaaccttctgacaggggagcggttcgctgcagaggcggaaacactttgcgtctccttgccgccgtacgggtttgtgctttacgcggtcgaaagctggtaa

SEQ ID NO: 1987 - protein, 588 aa, BACILLUS SP. WPD616
MRKEAIHHRSTDNFAYAYDSETLHLRLQTKKNDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFGPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYQLADAALRFFAKEDMSASEFADRLMHVLHSYPKQVNEAAFNLLGSHDTPRLLTVCGGDVRKVKLLFLFQLTFTGSPCIYYGDEIGMTGGNDPECRKCMVWDPEKQNKELYEHVKQLIALRKQYRALRRGDVAFLAADDEVNHLVYAKTDGNETVMIIINRSNEAAEIPMPIDARGKWLVNLLTGERFAAEAETLCVSLPPYGFVLYAVESW

SEQ ID NO: 1988 - DNA, 2100 bp, Bacillus stearothermophilus; identical to SEQ ID NO: 1737

SEQ ID NO: 1989 - protein, 590 aa, Bacillus stearothermophilus; identical to SEQ ID NO: 1738

SEQ ID NO: 1990 - DNA, 2726 bp, Bacillus stearothermophilus; identical to SEQ ID NO: 1976

SEQ ID NO: 1991 - protein, 717 aa, Bacillus stearothermophilus; identical to SEQ ID NO: 1977

SEQ ID NO: 1992 - DNA, 2166 bp, Bacillus subtilis; identical to SEQ ID NO: 1720

SEQ ID NO: 1993 - protein, 589 aa, Bacillus subtilis; identical to SEQ ID NO: 1721

SEQ ID NO: 1994 - DNA, 2933 bp, THERMUS SP. IM6501
gagctcggctcctttgacggctccatcattcgcgagcccaatgtcgcttatgtcgtatttgccgttttcatttttaaacacatagccgccatagccggcgaagaacggataaacgaaatagaaattcgctgcttccattaaaaagccgtattggtctctggccgcattcgttttttccttggcgatcttcatcaagtcatccatcgttttcggcgcttccggcactaaatttttattgtagaacacgccgtatgtttcaacgaccatcgggacgccatacgttttcccgtcatatgttaccgcgttgatggctgtcgggctgtactcaccttttgcatcgccaaggtcgaccggatcggccagcccctgcaacacaatgtcgccgatgcgatcatgcggttgatagaacatgtccggccctttgccagccggtccgtcgagtgccagttttttcgtttggtcgagcatgctgacggctaccatttcgattttgattcccgttttttctgtgtacttttgaaaaatatcctttaacgcttgtttttgtttttcatcatcgttcacccatacgacgagtttctctggctttttgtcctgttctgccgtcttttggtcgtttcctttcggctgctggacatcgcgcttaggaccgcaggcacccagcacgccaatcaacagcacggccataagaaataaagataacgcttttctcataatccccctcctgtcatcatgacggaatcttagcggtacaatcataaggcaaacgtttgcttcagataacaaaggaggaaaaagcgaatgaggaaagaagccatccaccaccgctcaaccgacaatttcgcttatgcttatgacagcgagacgctccatctccggcttcaaacaaagaaaaatgatgtcgaccacgtcgagctgctttttggcgacccgtacgaatggcacgatggcgcctggcagtttcaaacgatgccgatgcggaaaacggggagcgacgggttgtttgactattggctcgccgaagtcaaaccgccatatcgacggctgcgctatgggtttgtgcttcgagctgggggcgagaaactggtctatacggaaaaaggattttaccatgaagctccgagcgacgacaccgcttactacttttgcttcccctttcttcatcgggtcgacctattccaagcgccggactgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggtattaccggcatttacttgacgccgattttccgcgcaccgtccaatcataaatacgacaccgctgattattttgaaatcgacccgcactttggggacaaagagacgttgaaaacacttgtcaagcgctgccatgaaaaagggatccgcgtcatgctcgatgcagtcttcaaccattgcggctatgagtttgccccgtttcaagatgtgctgaaaaacggcgcagcctctcggtataaagattggttccatattcgcgagtttccgctccaaaccgagccgcgcccgaactacgacacgtttgcgttcgtgccgcacatgccgaaactcaacaccgctcatccggaagtgaagcgctacttgcttgatgtcgcgacatactggattcgcgagtttgatattgacggctggcggctcgatgtggcgaacgaaatcgatcatcaattttggcgcgaattccggcaggcagtgaaggcgctaaagcccgatgtgtacattctcggcgagatttggcatgacgccatgccttggctgcgcggcgaccagtttgacgccgtcatgaactacccgttggcggacgcggcgctccgctttttcgccaaagaagacatgagcgccagcgagtttgccgaccgattgatgcatgtgcttcattcctatccaaaacaggtcaacgaagcggcgtttaacttgcttggcagccatgatacaccaaggctgctcactgtttgcggcggcgacgtccgcaaagtgaagttgttgtttttgttccagctcacgttcactggttcgccgtgtatttactatggcgatgagatcggcatgacgggtggaaacgatccggaatgccggaagtgtatggtgtgggatccagagaagcaaaacaaagaactgtatgaacatgtcaagcaactgatcgctcttcgcaagcaatatcgggcgcttcgacgcggcgatgtcgcttttctcaccgccgatgatgaagtgaaccatcttgtttatgcaaaaacggatggcaatgaaacggtcatgatcatcatcaaccggagcaacgaagcagcagaaattcccatgccgatcgatgcgcgtggaaaatggctggtcaaccttctgacaggggagcggttcgctgcagaggcggaaacactttgcgtctccttgccgccgtacgggtttgtgctttacgcggtcgaaagctggtaaggcgactgaacgggcggttacggacaaacatatcatatcggctgccggtgcagcggacaagctgcaccggtttgatcttttgccggccgtctcgatccctataccaacgacacagaaggtcaggtgcgccgcgccatgcgccgatattcggtcggcgtgattccttccacctttttaaacaggcgcgaaaagtaggcgccatcgtcaatgccaacccgcttggcgatcgcctcgatcgtctcgttcgtctccgccaaccattgctttgcctttgacagccgataatgcgccaagtagcggctaaatcccatgcccatcgttttttgcatgcagcgggtgatgtagtccgggtggaatcggagctc

SEQ ID NO: 1995 - protein, 588 aa, THERMUS SP. IM6501
MRKEAIHHRSTDNFAYAYDSETLHLRLQTKKNDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPHMPKLNTAHPEVKRYLLDVATYWIREFDIDGWRLDVANEIDHQFWREFRQAVKALKPDVYILGEIWHDAMPWLRGDQFDAVMNYPLADAALRFFAKEDMSASEFADRLMHVLHSYPKQVNEAAFNLLGSHDTPRLLTVCGGDVRKVKLLFLFQLTFTGSPCIYYGDEIGMTGGNDPECRKCMVWDPEKQNKELYEHVKQLIALRKQYRALRRGDVAFLTADDEVNHLVYAKTDGNETVMIIINRSNEAAEIPMPIDARGKWLVNLLTGERFAAEAETLCVSLPPYGFVLYAVESW

SEQ ID NO: 1996 - DNA, 4499 bp, Bacillus acidopullulyticus; identical to SEQ ID NO: 1980

SEQ ID NO: 1997 - protein, 586 aa, Bacillus acidopullulyticus; identical to SEQ ID NO: 1981

SEQ ID NO: 1998 - protein, 346 aa, Bacillus acidopullulyticus; identical to SEQ ID NO: 1982

SEQ ID NO: 1999 - protein, 183 aa, Bacillus acidopullulyticus; identical to SEQ ID NO: 1983

SEQ ID NO: 2000 - DNA, 1767 bp, Bacillus thermoalkalophilus
atgttgaaagaagccatttatcatcgtccaaaagataactttgcttatgcgtacaatgaaaaaacgttacatattcgccttcgtacgaaaaaaaatgatatcgaaaccgtttaccttctttatgctgatccgtatgaatgggtaaacggcgtttggcagctgaaccgtgctcccatggtgaaaagcgggtcagacgatttgtttgactactggtttattgaagttgttcctccataccgccgccttcgttacgggtttgaattaacagcaggcagtgaaacgatagtatatacggaaaaaggtttttacaacgaggcaccaacagatgataccgcttactatttttgctttccttttttaaataaaatcgatgtatttcatgcgcccgaatgggcaaaagatacgatttggtatcaaattttcccggagcgctttgcaaatggaaatccgtctttgaatccagagggaacgctaccttggggaagcgaagaaccgacaccaacaagttttttcggcggcgattttgaagggattatacaacaccttgattatcttgttgagctcggtattaacggcatttattttactcctattttctatgcgccatctaatcataaatatgatacgatagattattttgaaatcgatccacattttggagataaacaaacatttaaaaaacttgttgatctttgccatcaaaaaggaataagagtgatgctagatgcagtatttaatcattgcggttactattttgcaccgtttcaagatgtactaaaaaatggtaataattcaaaatataaggattggtttcatattcacgaatttccgttacggacagtcccaagaccaaactatgatacgttcgcatttgttgagcaaatgccaaagttaaatacggaaaatcctgaggtaaagcagtatttattagatgtagcaacatattggattcgcgagtttgatatcgatggatggcgattagatgtagcaaacgaagtagaccaccaattttggcgagaattccgtcaagcggtgaaagcaatcaaaccggatgtttatattctcggagaaatttggcacgatgcaatgccatggcttcgaggcgatcaatttgatgctgtcatgaattatccatttacgaatggcgttatccgctttttcgccaaagacgaaatccgtgctgaacaatttgctaatataattatgaacgttctgcattcttacccagcaaacgtcaatgaagtcgcttttaacttgcttggcagtcacgatacaccaagaattttaacgacatgtaacaatgacgtacgaaaagtcaaactgctatttttattccaactctcttttaccggttctccatgcatatactatggtgacgaaattggtatgacaggtgggcaagatccaggatgccgcaaatgtatgatttgggatgaaagtaaacaagaccgcgatatattagaacatgtgaaaaaactcatttcgcttcgcaagactcatcctgctcttggaagtcaaggaaatattacatttattgatgcaaataatgaaacaaatcatttaatatatacgaaaacatacaagcacgaaacgattttagttatgatcaacaataacaacaaaaatattgaagtcacggtcccattgtctcttaaaggaaaacggctaacgaacttatggacaaacgagcaatttgctgtagaagcaaaaacattgcgtgcaaacattcctccatacggttttctcctcaatcaagtagaaaattga

SEQ ID NO: 2001 - protein, 588 aa, Bacillus thermoalkalophilus
MLKEAIYHRPKDNFAYAYNEKTLHIRLRTKKNDIETVYLLYADPYEWVNGVWQLNRAPMVKSGSDDLFDYWFIEVVPPYRRLRYGFELTAGSETIVYTEKGFYNEAPTDDTAYYFCFPFLNKIDVFHAPEWAKDTIWYQIFPERFANGNPSLNPEGTLPWGSEEPTPTSFFGGDFEGIIQHLDYLVELGINGIYFTPIFYAPSNHKYDTIDYFEIDPHFGDKQTFKKLVDLCHQKGIRVMLDAVFNHCGYYFAPFQDVLKNGNNSKYKDWFHIHEFPLRTVPRPNYDTFAFVEQMPKLNTENPEVKQYLLDVATYWIREFDIDGWRLDVANEVDHQFWREFRQAVKAIKPDVYILGEIWHDAMPWLRGDQFDAVMNYPFTNGVIRFFAKDEIRAEQFANIIMNVLHSYPANVNEVAFNLLGSHDTPRILTTCNNDVRKVKLLFLFQLSFTGSPCIYYGDEIGMTGGQDPGCRKCMIWDESKQDRDILEHVKKLISLRKTHPALGSQGNITFIDANNETNHLIYTKTYKHETILVMINNNNKNIEVTVPLSLKGKRLTNLWTNEQFAVEAKTLRANIPPYGFLLNQVEN

SEQ ID NO: 2002 - DNA, 2100 bp, GEOBACILLUS STEAROTHERMOPHILUS; identical to SEQ ID NO: 1737

SEQ ID NO: 2003 - protein, 590 aa, GEOBACILLUS STEAROTHERMOPHILUS; identical to SEQ ID NO: 1738

SEQ ID NO: 2004 - DNA, 1483 bp, Hypsizygus marmoreus
gggttctttcaagcgaggacctctggcatggatggcccatcctttgtcaatcagtgtcctatccctccgaacacgacgttcctttacgacttcgatacagctggtcagactgggaacttctggtaccactcccacttgtctactcagtattgcgatggccttcggggagttttccctgtctatgaccccaaggaccctttgagacacctctacgatgtcgacgacgcgagcactatcattacccttgctgactggtaccacggtctcgctcccgaagctcagaagaagttctttacgtctggaaccgtcccgatccctgattcgagtttgattaacggtgttggtcgctacaacggcggcccgctcgttccatttgctattgtcaatgtcgttcgcggaaagcgttataggttccgagtcttttccttgtcctgccgaccattctttactttctcaatcgacaaccacacgttcgacgtcatggagttcgatggtatcgaacacgacccagttccggcccaaaatttcgatatctatgctgcgcaacgtgtttcgataatcctcaacgccaaccagactgtcaacaactactggattcgcgcgttcccgactggcggaaatcctgccgggaaccccaacttcaacccggctctgtcccttgcaattctccgttacaagggcgcgcctgccgttgagccgactaccgtcaacgtacccggtaagaagctcgttgaaggtgatatgcatcctatcagggaggagcttcctggaaaacttggaagcggtccggccgacgtcgcaattgtgctcaacattgctcagcccaacccaccattcttcgatatcaatggcatctcgtacatttctcccccagtcccggtgttattgcagcttctgagtggtgcccaaacaccccaagatctcctaccatcggaacaagtcttccttctgcctcctaacaagctcatagagatttctgttccagggacaggcgcccatccattccatttgcatggccatgcattcgacctcgtccgcacctcaaactctgatgttgtcaattatgttaaccctccgaggcgagacgtcgctgctgtcaatggtggaaacatgactttcaggttcttcagtgaaaaccctggagcctggttcctgcactgccacatcgactggcacttagaagctggcctggctgtggtgtttggagaagcccctgctgacaatatttccggaccgaagtcccagattacacccaaggactggcagaacctgtgcccctcctataacaagctccgtcctgagttccagtgatctactagactgcgccgtcgtgtgctgccatgggcttcgcagggcttgaattggttattacttttattttcggccgtgacgcgtgttgtaaatctgcgaatccgccgcttggttctcgctcttaaatatggaacgcaatgaaattgtactctcttgacaaatagaaaaaaaa

SEQ ID NO: 2005 - protein, 436 aa, Hypsizygus marmoreus
GFFQARTSGMDGPSFVNQCPIPPNTTFLYDFDTAGQTGNFWYHSHLSTQYCDGLRGVFPVYDPKDPLRHLYDVDDASTIITLADWYHGLAPEAQKKFFTSGTVPIPDSSLINGVGRYNGGPLVPFAIVNVVRGKRYRFRVFSLSCRPFFTFSIDNHTFDVMEFDGIEHDPVPAQNFDIYAAQRVSIILNANQTVNNYWIRAFPTGGNPAGNPNFNPALSLAILRYKGAPAVEPTTVNVPGKKLVEGDMHPIREELPGKLGSGPADVAIVLNIAQPNPPFFDINGISYISPPVPVLLQLLSGAQTPQDLLPSEQVFLLPPNKLIEISVPGTGAHPFHLHGHAFDLVRTSNSDVVNYVNPPRRDVAAVNGGNMTFRFFSENPGAWFLHCHIDWHLEAGLAVVFGEAPADNISGPKSQITPKDWQNLCPSYNKLRPEFQ

SEQ ID NO: 2006 - DNA, 1596 bp, Pleurotus eryngii
atgtttccaggcgcacggattctcgctacgcttacattagctcttcaccttttacatggcactcacgctgccatcgggcccattgccgacatgtacatcgtcaacgaggacgtctctcctgacggcttcgctcgttcggctgtcgtcgctcgctctgtgccggccacagatccgacgcctgcgtcggtatcggttcctggcgtcctcgtgcaaggaaacaagggcgataactttcagctgaacgttcgcaatcaactgtcggactcgactatgttgaagactactagtatccattggcatggcttctttcaatccggctctacgtgggcagatggacccgcgttcgtgaatcagtgccccatcgcctcggggaatagcttcctatatgactttaacgttcccgaccaagctggcacgttctggtaccattcgcatctttccacccagtattgtgatggtcttagaggaccattcgtagtatacgatccctccgatccccacctgtccttatatgacgttgacaacgccgacactgtcattacacttgaagattggtaccacgttgcggcccctcagggtgcagtgcttcctactcctgatagcacgctcatcaatggtaaaggtcgcttcgccggggggccgacttcccctttggctatcatcaacgtcgaaagcaacaagcgatatcgtttccgacttatctcgatgtcttgcgaccccaatttcacgttctcaatcgacggtcactctttgcaggtcattgaagcagatgctgtcaatattgtgcccctcgtcgtggatagtattcaaatcttcgcgggccaacgctattctttcgtcctgaatgccaatcaggctgtcgacaattattggattcgcgcaaatcccaacttgggatcgactggcttcgaaggtggcatcaattccgctatccttcgctatgctggtgccactgaaaatgaccctgccacgacttcgtcgacgagcactccccttctggagactaatcttgtgccactcgaaaatcctggtgctcctggtccagctgtccctggaggcgcagacatcaacatcaatcttgctatgggcttcgactttactaactttgaaatgaccatcaacggttcccccttcaaagcaccaactgctcctgttctgctccagattctgtcaggtgctacgcctgccgcttcgcttcttccttcaggtagtatatacgcgctagaagccaacaaagttgtcgaaatctccatacccgccttagctgtcggaggaccgcatcctttccatcttcacggacacacgttcgacgtcatcaggagtgcgggctctactacgtataacttcgacacccctgcgcgacgcgatgttgtcaacactggaattgacgcgaacgacaacgttaccatccgctttgtgacggataatccgggcccatggttcctccactgccacattgactggcatctcgaaatcggtctcgcggtcgttttcgccgaagatgtggcgtccatcaaggccccacctgccgcgtgggacgacttgtgtccgatttatgatgctttgagcgattccgacagaggtggcatagcttag

SEQ ID NO: 2007 - protein, 531 aa, Pleurotus eryngii
MFPGARILATLTLALHLLHGTHAAIGPIADMYIVNEDVSPDGFARSAVVARSVPATDPTPASVSVPGVLVQGNKGDNFQLNVRNQLSDSTMLKTTSIHWHGFFQSGSTWADGPAFVNQCPIASGNSFLYDFNVPDQAGTFWYHSHLSTQYCDGLRGPFVVYDPSDPHLSLYDVDNADTVITLEDWYHVAAPQGAVLPTPDSTLINGKGRFAGGPTSPLAIINVESNKRYRFRLISMSCDPNFTFSIDGHSLQVIEADAVNIVPLVVDSIQIFAGQRYSFVLNANQAVDNYWIRANPNLGSTGFEGGINSAILRYAGATENDPATTSSTSTPLLETNLVPLENPGAPGPAVPGGADININLAMGFDFTNFEMTINGSPFKAPTAPVLLQILSGATPAASLLPSGSIYALEANKVVEISIPALAVGGPHPFHLHGHTFDVIRSAGSTTYNFDTPARRDVVNTGIDANDNVTIRFVTDNPGPWFLHCHIDWHLEIGLAVVFAEDVASIKAPPAAWDDLCPIYDALSDSDRGGIA

SEQ ID NO: 2008 - DNA, 2402 bp, Coprinus cinereus
atgcatccccaccttcgacctctcttggtcgcgcttactagtagctttgccttgcagaactttgccgcggcagcgttgaccaccccgagagccattcactcaaaggatactatgatcatttccaacattcgagctagccctgatgggtttgaacgaccgtacgcaaacaatctatacaggtaattaaccgtcttatgctcacagcctttcagtgtcatcgctgtcaatggacatcacccagccctcttgatcaaggcgaagaaggtatgtatcatgtcgaacgaaattgcggtcgcttgatgcttaactttacctctcagggcgacgagtttgagcttacagtcgccaatcacctaacagaagagaccatgcttcgtcaaactagcattgtaaggatccgtcttcccgactagcaggtagcgcgcttgctgagaaccggtttgcattgtcggtgtattagcactggcacggcatcttccaacataaatcctcctgggccgatggaccagaaggcgtcacccagcgccctgtcgcgcaattcgacaactcattcacttacaagttcaatgctgggaacgaaaccggcacctactggtaccactcccatttcggtaatgctgtggtcatctttggaaattcatgcagctccgctgatcttgagcgtgacggcagaaacccaatattgcgatggcctgagagggcccttggtcatatacgacgataacgacccgtacaggaatgattacgacggtgggcatattcttatctgttccattatttctgttcaacctgtattccccgcagtcgacaacgaagacacgatcatcacgctcgccgactggtaagtcactcgccgataccatttcccaacgtctacattattccctcttcatacaggtatcaccttcaggcaccgtctatcaacataaccattgccccacctgtgaatgcaactctgatcaacgggaaagggcgacagcctgtcaagcccgatagtccgcttgccatcgtgaacgtgaagcaaggcaagaggtatagattccgcatcctctcctcgtcctgcgacccgaactacaatttctccatcgacggacacgacctcaccgtcatcgaagccgacgggcagcttaccagaaagcttgtcgtgcaaagactccagattttcgctggtaagtcttaacttcagcggagaccctaaacccccttcactgactggctgtgatacactgggccgtccaggtcaaaggtactccgttatcctgcacgccaataggcccaaaggaaactactggatccgtgcagagcccaacttcggcgttggcttgaatggcaccagcggaacaaaggccaatggagtcaactcggcaatccttcgctattacggcgcaaacgatgaggaacccaaagaccggcccttcacgaaccccatcgatctgaaagaattcaacttacatgcactactcaaccctagcccccctggtagaaaccagcctgcagacaagacctttttcttcaacattacttttaacggagggcgatggtggatgaatcaaacagctgaagggacaccaattggaagctggcattcacctcacacggactccaagggacccgttttacttcagatcctcaacggcgtcaaaccagagaaattggtacccaaagactcgatcttccatgtgaagcgcaaccaggtcatcgagatcacacttccggctttcacaattggtccagtgagtcttgctgtcatgccgatgaccaggggtgaactactaacccttctcgtgttcagcatccgttccatttgcacggggtaaaaacttctgttaacgtccagagtgaaagatgtctgacctctcatctcgcagcacgcgttcagcgttatccagagtgcagggagccccaataagaactatatcgaccctgttcgtcgcgacgtagtcagcatcggagatccagacagaaaggagaacgtgaccatccggttcgtcactgataacccaggtccttggttcttccactggtacgtggcgcgtcaaaattcaatgttcaacgacactgacgatttgtggccgggcttgcgttagccacatcgagttccatctgtccgggtaagcccctaacgtttgacgttcgtacaggtgacgctgacgaaggacatcactccagtggccttggtgctgttttcgtcgaggatcagaaggacatcaagtcaagcgaccgcgctccccctcgtacgtgcacttggtcaggcccacagagaaagtacgcactaatataatatggcagcgagctggtctgaattgtgcccaactttcgatgcgctacccactaacgcaaccttcgtctccacagtcgctacaccctctgcgcctacagctccaaccaacattcccttctag

SEQ ID NO: 2009 - protein, 562 aa, Coprinus cinereus
MHPHLRPLLVALTSSFALQNFAAAALTTPRAIHSKDTMIISNIRASPDGFERPVIAVNGHHPALLIKAKKGDEFELTVANHLTEETMLRQTSIHWHGIFQHKSSWADGPEGVTQRPVAQFDNSFTYKFNAGNETGTYWYHSHFETQYCDGLRGPLVIYDDNDPYRNDYDVDNEDTIITLADWYHLQAPSINITIAPPVNATLINGKGRQPVKPDSPLAIVNVKQGKRYRFRILSSSCDPNYNFSIDGHDLTVIEADGQLTRKLVVQRLQIFAGQRYSVILHANRPKGNYWIRAEPNFGVGLNGTSGTKANGVNSAILRYYGANDEEPKDRPFTNPIDLKEFNLHALLNPSPPGRNQPADKTFFFNITFNGGRWWMNQTAEGTPIGSWHSPHTDSKGPVLLQILNGVKPEKLVPKDSIFHVKRNQVIEITLPAFTIGPHPFHLHGHAFSVIQSAGSPNKNYIDPVRRDVVSIGDPDRKENVTIRFVTDNPGPWFFHCHIEFHLSGGLGAVFVEDQKDIKSSDRAPPPSWSELCPTFDALPTNATFVSTVATPSAPTAPTNIPF

SEQ ID NO: 2010 - DNA, 150 bp, Pleurotus eryngii
cattggcatggcttctttcaatccggctctacgtgggcagatggtatgtcttcactacgtattacgatgcctcgctaatcttcttcaaggagccgcgttcgtgaatcagtgccccatcgcctcggggaatagcttcctgtgagtgtcctt

SEQ ID NO: 2011 - protein, 31 aa, Pleurotus eryngii
HWHGFFQSGSTWADGAAFVNQCPIASGNSFL

SEQ ID NO: 2012 - DNA, 204 bp, Pleurotus eryngii
tggaatgacatcgcttacaccacgaatggtcctcttaggccatcgcaatattgggtagaaagatgcgagtgataccctgcagaagtggtcagaagacgcagaaaggatgccaagacgaacaacttacaaaacgttccagcttggtctgggacattgaaattgtaccgtgaggatattttgattaatcaaggactagagataaag

SEQ ID NO: 2013 - protein, 32 aa, Pleurotus eryngii
YNFNVPDQAGTFWYHSHLSTQYCDGLRGPFVV

SEQ ID NO: 2014 - DNA, 1899 bp, Sclerotinia minor
atgaagtgttttacatcactcactgccctcactgcaatctttgcacaggcatctgcttcagctattccagctattcgctcgccggccacttcacaccaaaaagtgactgcctcctgtgcacactcggctacttcccgatcctgctggggagcttactccatcgataccgactggtatgatgttataccacacactggagttaccagaggtatgcgatatcacattctcattcactacctagtctagtactaatttatgcatagaatactggctttcggttgagaactccactataacccctgatggttatacccgctcagccatgaccatcaatggaaccgtccctggccctgcaattatcgcggactggggcgacaatcttgtaatccgtaagtctccgatagcgcaccgaatctcaaaagtcctcgatagcatgggatatcctcaatcatccttttgcatgtttctcttcactaactacgagtcacagatgtcaccaacaatcttcaacacaatggaacagccattcacttccacggtattcgtcagaagggaagcttagagtacgatggtgtgcccggtgttactcaatgtcctatcgctcctggagataccttgacctacaagttccaagctactcaatatggaactacttggtatcactctcacttctctcttcaatacgctgatgggctcttcggccctctcatcattaacggtcctgccactgcagactacgatgaggatcttggagtaatgtttttgggtgattgggcacacgaaaccgtcttcgatctttgggatcgcgctagatccggccctcctatctctcttccaaacactttgatgaacggaaccaacagttgcgagtgcgatacttctgatcctcagtgcgttggtggtggtaagaaattcgaggcagttttcgtcgagggccaaaagtacagaatcagattgatcaatgttggtattgacagtcatttcgaattcgccattgatggccacactcttaccgtcattgctaatgatcttgttcctatcgtcccatataccactgagactctcctcattggtattggtcaaagatacgatgtcatcgtcgaagctaatgctaagcctaataactactggatccgcgccaactggggaactgcttgctcatccaacctgcgagctgccaacgccacgggaatcttgcgatacaacagctccagcaccgcagaacctacctctgtcggcgccaccccacgcggtacttgtggggatgaaccacttgccagcttggttccgcatttagcaatggatgtcggtgactatgctctcatggacgagaaattaaactggatcctcggcaacgtcataacctggaccatcaacagcagctctctcgtcctcgactggaccaacccaaccacgctccaagtattccgcaacgaatcaatcttcccaacagactacaacgtcgttcctatcagcaaggaaatcacaaactcagactgggtcgtctatgtcatcgaagatctcaccaccgccggtacctggcaccctatgcatctccacggccacgatttcttcatcgtcggtcaggaacaagccgtcttcgaccccgtcaacaccccttccactttcaaccttaagaatcctcctcgtcgtgacgtggctgctcttcccgccggcggctacctcgctatcgctttcaagctcgataaccctggttcgtggcttcttcactgccatatcgcgtggcacgcatccgagggtttggctatgcagtttgttgagtctgagagctcgattgccattggtatgaaggatacccagatctttgataatacgtgcaagaattggaatgcatatgttccaactgaggtatttcctcaagacgattctggtatctag

SEQ ID NO: 2015 - protein, 580 aa, Sclerotinia minor
MKCFTSLTALTAIFAQASASAIPAIRSPATSHQKVTASCAHSATSRSCWGAYSIDTDWYDVIPHTGVTREYWLSVENSTITPDGYTRSAMTINGTVPGPAIIADWGDNLVIHVTNNLQHNGTAIHFHGIRQKGSLEYDGVPGVTQCPIAPGDTLTYKFQATQYGTTWYHSHFSLQYADGLFGPLIINGPATADYDEDLGVMFLGDWAHETVFDLWDRARSGPPISLPNTLMNGTNSCECDTSDPQCVGGGKKFEAVFVEGQKYRIRLINVGIDSHFEFAIDGHTLTVIANDLVPIVPYTTETLLIGIGQRYDVIVEANAKPNNYWIRANWGTACSSNLRAANATGILRYNSSSTAEPTSVGATPRGTCGDEPLASLVPHLAMDVGDYALMDEKLNWILGNVITWTINSSSLVLDWTNPTTLQVFRNESIFPTDYNVVPISKEITNSDWVVYVIEDLTTAGTWHPMHLHGHDFFIVGQEQAVFDPVNTPSTFNLKNPPRRDVAALPAGGYLAIAFKLDNPGSWLLHCHIAWHASEGLAMQFVESESSIAIGMKDTQIFDNTCKNWNAYVPTEVFPQDDSGI

SEQ ID NO: 2016 - DNA, 361 bp, CRINIPELLIS SP. RCK-1
actattggttgtccgttcctgaccaagatgggacgtagtggtatcactcccagttcggtgctcaatactgtgatggattgagaggtcctttggtgatttatgatccacaggatcctcagaagagcatgtacgatatagatgacggtcagcagcaatagccattcacaccccgtaccaagctctaacgatgtcttgcagaaaacactatcataacacttgcagactggtacagcgacactcactggcacggattcttccaaacccacaccaactgggctgatggacctgccttcgtgaaccaatgcccaatttccccaggaaccaggcttcttgtacggactacccagtagtacagcggtgg

SEQ ID NO: 2017 - protein, 120 aa, CRINIPELLIS SP. RCK-1
TAVLLGSPYKKPGSWGNWALVHEGRSISPVGVGLEESVPVSVAVPVCKCYDSVFCKTSLELGTGCEWLLLLTVIYIVHALLRILWIINHQRTSQSITVLSTELGVIPLRPILVRNGQPIV

SEQ ID NO: 2018 - DNA, 1733 bp, PHOLIOTA NAMEKO
gtgcgacaatatgctttctctcccgatccttgtctatttatctaccatcacgagtgcctatgctgcaataggcccaactgcaaacgtgcacattgccaacaagattatttcgcctgacggctttaaccgctctgctgttttagctggtaccaacgcgagctccatcgcctttccaggcccagtaattacggggttcaagggtgatacgttccaactcaatgtaatcgacgccttaaccaacacgacgatgctaaggagcacgtctattcattggcacggcttcttccagagaggcagcagctgggccgatggtccagtcggggtgacccagtgccctatttctccggggaactcgttcgtgtatcaattctcttctgcagaccaagcaggcacgttctggtaccactcccatcattccacgcaatattgtgacggcctccgaggagcgatggttgtctacgaccgtcaggaccctcacagaaacagatacgagttcgacgatgagagcactatcattactctcgccgactggtaccatgtcgtcgccccatctgctggactcgtccccacccccgacgccactttgattaatgggattggacgttacgccggtggtcccactgtacctctcgcggtcatccgagtcttgcccaataggcgctaccgcttccgactggtatctatctcctgcgatcctaactacacgttctccatcgacggacacaacatgacgattatcgaagtcgaaactgtaaacacaaccccactcgaggtcgacttgatccagatattcgccggacagcgctattccttcgtcctgaacaccaatcaacccgtgtccaactattggatccgcgcggaaccaaacgtcggcacccaaggtttcgccggcgggatcaattctgccattttgagatattggggcgcaccaaccattgatccaaacacgacctcggcgcttagtaatccccttcgggagacaaatttagttccgctctcaggggctgccgcacctggcactccccaagtgggcgcggcggacgtgaacctcaacctcgacattttgttcaacgcgactaacaacagattcacggttaacaacgccacatttgctccgccgaccgtccctgttctcctgcagatcatgaacggcacaaggacagctgcggaactgcttccgaggggttctgtttacgttctgccgcccaacagagtcgtcgagctctcccttcctggcgggtctgttggaagtccgcaccccatacatcttcatggacacaccttcgatgtcgtccgtagcgtcggaagctcggcctataattacgccaacccgattaaacgcgacgtggtcagcattggcggtgcaggcgacaatgtcaccattcgattcaggacggacaacccgggaccttggatcatgcactgccacattgactggcacttcgaaatcggcctctcggtagtgtttgccgaagacgttgatacggttaatgtttctactcctgccgcctggagccagctttgccctaactacaacgcgaccaacgctccgtaagcccataacccttactaggccggtcgccgtaaccaacaagtcgttcattcaattatttatcttcgctttcttatattaaatcaatcccttctttaccgcttatcggcctcctgtctaaccccaaagtatgaatgtatatgattcttttctaccaaaaaaaaaaaaaaaaaaaaaaaaa

SEQ ID NO: 2019 - protein, 514 aa, PHOLIOTA NAMEKO
MLSLPILVYLSTITSAYAAIGPTANVHIANKIISPDGFNRSAVLAGTNASSIAFPGPVITGFKGDTFQLNVIDALTNTTMLRSTSIHWHGFFQRGSSWADGPVGVTQCPISPGNSFVYQFSSADQAGTFWYHSHHSTQYCDGLRGAMVVYDRQDPHRNRYEFDDESTIITLADWYHVVAPSAGLVPTPDATLINGIGRYAGGPTVPLAVIRVLPNRRYRFRLVSISCDPNYTFSIDGHNMTIIEVETVNTTPLEVDLIQIFAGQRYSFVLNTNQPVSNYWIRAEPNVGTQGFAGGINSAILRYWGAPTIDPNTTSALSNPLRETNLVPLSGAAAPGTPQVGAADVNLNLDILFNATNNRFTVNNATFAPPTVPVLLQIMNGTRTAAELLPRGSVYVLPPNRVVELSLPGGSVGSPHPIHLHGHTFDVVRSVGSSAYNYANPIKRDVVSIGGAGDNVTIRFRTDNPGPWIMHCHIDWHFEIGLSVVFAEDVDTVNVSTPAAWSQLCPNYNATNAP

SEQ ID NO: 2020 - DNA, 1584 bp, Trametes versicolor
atgggcaagtttcactcttttgtgaacgtcgtcgccctcagtctttccttgtgcggtcgtgtgttcggcgcgattgggcccgtcgccgacttgactatctctaacgccgatgttacgcctgacggcattactcgtgctgctgtcctcgcgggcggcgtctttcccagccccctcattactggcaacaagggggatgaattccagatcaatgtcatcgacaacctgaccaacgagaccatgttgaagtcgaccacaatccactggcatggtatcttccaggccggcaccaactgggcagacggcgcggccttcgtgaatcagtgccctatcgccacggcaacctcgttcttgtacgacttcaccgttcctgatcaggccggcactttctggtaccacagccacctgtctacccagtactgcgacggcctgcgtgggccgctggtggtgtacgaccccgacgatcccaacgcgtctctttacgacgtcgatgacgataccacggttattacgctcgcggattggtatcacactgcggcgaagctgggccctgccttccccgcgggtccggatagcgtcttgatcaacggtcttggtcggttctccggcgatggaggaggagcgacgaacctcaccgtgatcaccgtcacgcaaggcaaacggtaccgcttccgccttgtgtcgatctcgtgtgaccccaacttcacgttctcgatcgacgggcacaacatgaccatcatcgaggtggacggcgtcaaccacgagtccttggacgtcgactccattcagatctttgcggggcagcggtactccttcatcctcaacgccaaccagtctatcgacaactactggatccgcgcgatccccaacaccggcaccaccgacaccacgggcggtgtgaactccgccattctacgctacgacaccgccgaagagatcgagcctacgaccaacgcgaccacttcagtcatccctctcaccgagaccgatctggtcccgctcgacaacccggcggctcccggcgatccccaggttagcggtgttgacctggctatgagtctcgacttctccttcaacggctccaacttcttcatcaacaacgagaccttcgtcccgcctacagtgcctgtgctcctgcagattttgagcggtgcgcaggatgcggcgagcctgctccccaacggcagtgtctacacactcccttccaactcgactattgagatctcgttccccatcatcaccaccgacggtgctctgaacgcgcccggtgctccgcacccgttccatctccacggtcacactttctcggtggtgcgcagcgccgggagctcgaccttcaactacgccaacccagtgcgccgggacaccgtcagtactggtaactctggcgacaacgtcactatccgcttcacgaccgacaacccgggcccatggttcctccactgccacatcgacttccacctggacgcgggcttcgccatcgtttttgcggaggacactgcggacaccgcgtccgcgaatcctgttcctacgacgtggagcgatttgtgccccacttacggtgctttggactcgtccgacctctga

SEQ ID NO: 2021 - protein, 527 aa, Trametes versicolor
MGKFHSFVNVVALSLSLCGRVFGAIGPVADLTISNADVTPDGITRAAVLAGGVFPSPLITGNKGDEFQINVIDNLTNETMLKSTTIHWHGIFQAGTNWADGAAFVNQCPIATATSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHESLDVDSIQIFAGQRYSFILNANQSIDNYWIRAIPNTGTTDTTGGVNSAILRYDTAEEIEPTTNATTSVIPLTETDLVPLDNPAAPGDPQVSGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTTWSDLCPTYGALDSSDL

SEQ ID NO: 2022 - DNA, 1563 bp, Trametes versicolor
atgtcgaggtttcactctcttctcgctttcgtcgttgcttcccttgcggctgtggcccacgctggtatcggtcctgtcgccgacctcaccatcaccaacgcagcggtcagccccgacgggttttctcgccaggccgtcgtcgtgaacggtggcacccctggccctctcatcaccggtaacatgggggatcgcttccagctcaatgtcatcgacaacctcacggaccacacgatgctgaagagcaccagtattcactggcacggtttcttccagaagggcaccaactgggccgacggtcccgccttcatcaaccagtgcccgatctcatctggccactcgttcctgtatgacttccaggttcctgaccaggctggcaccttctggtaccacagtcacttgtccacgcagtactgtgatggtctgaggggtccgttcgttgtttacgacccgaatgacccggccgccgacctgtacgacgtcgacaacgacgacacggtcattacccttgcggattggtaccacgtcgccgcgaagctgggccccgcattccctctcggcgccgacgccactctcatcaacggtaagggacgctcccccagcacgaccaccgcggacctcactgttatcagcgtcactccgggtaaacgttaccgtttccgcctggtgtccctgtcgtgcgaccccaaccacaccttcagcatcgatggccacaacatgacgatcatcgagaccgactcgatcaacacggcgcccctcgtggtcgactccattcagatcttcgctgcccagcgttactccttcgtgctcgaggccaaccaggccgtcgacaactactggattcgcgccaacccgagcttcggtaacgtcgggttcaccggcggcatcaactcggctatcctccgctatgatggcgccgctgccatcgagcccaccaccacgcagaccacttcgaccgagccgctcaacgaggtcaacctgcacccgctggttgccaccgctgtccctggctctcccgctgcgggtggtgttgacctggccatcaatatggcgttcaacttcaatggcaccaacttcttcatcaacggcgcgtctttcacgcccccgaccgtgcctgtcctcctccagatcatcagcggcgcgcagaacgcgcaggacctcctgccctccggcagcgtatactcgctcccctcgaacgccgacatcgagatctccttccccgccaccgccgctgcccccggtgcgccccaccccttccacttgcacgggcacgcgttcgcggtcgtccgcagcgccggcagcacggtctacaactacgacaaccccatcttccgcgacgtcgtcagcacggggacgcctgcggccggtgacaacgtcaccatccgcttccgcaccgacaaccccggcccgtggtttctccactgccacatcgacttccacctcgaggccggcttcgccgtcgtgtttgcggaggacatccccgatgtcgcatcggcgaaccccgtcccccaggcgtggtccgacctctgcccgacctacgacgcgcgcgacccgagcgaccagtaa

SEQ ID NO: 2023 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTDHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPAAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 2024 - DNA, 3099 bp, Coriolus versicolor
ctgcaggaaaggtagggatggacgccgtgcaccagcaactgtctcgccaccagcaaccgtcccttggatatgtcgccacaaacccggtgtctacaatcgggtatctgtgctggtgaagtggtgtctgcggaacggcggtgctcgcgcttctcccgcctgcgaaccagcggcggcgagcgaccagaacccgaaccagtgctagtgcccgacacccgcgagacatttgtgcagggtgagttctattctttgggagacggcgctgcgcgtcggcactgaaagcgtcgcagttaggtgatgcagcggtcggctccgcgctatttttgacgtctggccagctatcctttgccgcgcctccgtacgcctcaggcgctctcgttcgctataggtataaatccctcagcttcagagcgtcgatcctcatcccacacgacatccgttccagtcttctcgtagcgcattctctagccgcccagcctccgctttcgttttcaacatgggcaagtttcactccttcgtgaacgtcgtcgccctcagtctttccttgagcggtcgtgtgttcggcgccattgggcccgtcaccgacttgactatctctaacgccgatgttacgcctgacggcattactcgtgctgctgtcctcgcgggcggcgtcttccccggccccctcattaccggcaacaaggtgagaccttctgctagctcccttgtacgtgcaccgttactaaagtcgcgctttgcgctgcaaacagggggacgaattccagatcaatgtcatcgacaacctgaccaacgagaccatgttgaagtcgaccacaatcgtaaggtgtttgctcccacgattaagcccgtcgcttactcgaagtgtgttggtagcactggcatggtatcttccaggccggcaccaactgggcagacggcgcggccttcgtgaaccagtgccctatcgcaacgggcaactcgttcttgtacgactttaccgttcctgatcaggccggtgagtttacacaccgccctttctgcgtcatactctgacgcgcggctggattaggcactttctggtaccacagccacctgtccacccagtactgtgacggcctgcgcggtcctctggtggtctacgaccccgacgatcccaacgcgtctctctatgacgtcgatgacggtgagagagctactcgtggacttgtatgaatgtgtctcatgctccctgcagataccacggttattacgctcgcggactggtatcacactgcggcgaagctgggccctgccttcccgtgagtctactattcctcgtctgttaacgtaggcgaccaccgctgatacgagagctaccagcgcgggaccggatagcgtcttgatcaacggtcttggtcggttctccggtgatggaggaggagcgacgaacctcaccgtgatcaccgtcacgcaaggcaaacggtgagtccgccatgagctggtttcaatagcgatattgacgagtccatgttatcctaggtaccgcttccgccttgtgtcgatctcgtgcgaccccaacttcacgttctcgatcgacgggcacaacatgaccatcatcgaggtggacggcgtcaaccacgaggccttggacgtcgattccattcagatctttgcggggcagcggtactccttcatagtacgttccctcgccctcgtggctatatccgcccgtctgctcacagaggcttctatatcgcagctcaacgccaaccagtccatcgacaactactggatccgcgcgatccccaacaccggcaccaccgacaccacgggcggcgtgaactctgccattctgcgctacgacaccgccgaagacattgagcctacgaccaacgcgaccacctccgtcatccctctcaccgagacggatctggtcccgctcgacaaccctgcggctcccggtgacccccaggttggcggtgttgacctggctatgagtcttgacttctccttcgtgagtataacagtactccgcgcagttcgcctattcacgcgggaatatcattcagaacggttccaacttcttcattaacaacgagaccttcgtcccgcccacagtgcccgtgctcctgcagattttgagcggtgcgcaggacgcggcgagcctgctccccaacggcagtgtctacacactgccttcgaactccattgagatctcgttccccatcatcaccaccgacggtgctctgaacgcgcccggtgctccgcacccgttccatctccacggtgtaagtccttgctttcctcagtgcctcgcttccatgacgtccgctgatcccacatatcccatgtgcagcacaccttctcggtggtgcgcagcgccggaagctcgaccttcaactacgccaacccagtccgccgggacaccgtcagtactggtaactctggcgacaacgtcactatccgcttcacggtacgtcttctccgcagccctcccgctcgtgtgtccgctgagcgctgaacaccgcccaccgtgctgctgcgcagaccgacaacccgggcccgtggttcctccactgccacatcgacttccacctggacgcgggcttcgccatcgtctttgcggaggacactgcggacaccgcgtccgcgaatcccgttcctagtacgtgcctgttgagctctttctgcccgttcagggcgctgatcgtgccttcctccgtgcagcggcgtggagcgatttgtgccccacttacgatgctttggactcgtccgacctctgatcgacgaggcttgaaggctgaagcagctgcggtcaattctcgtacacactttactcgcacattcatttttgtttggctcggaatcggaaccagtggtgcggggcccggaccgccttaacttagtactcgatgttttaatcaagcggatgcttctcagaatacacacagctctttgcagtgattgcgcactggtcatgtcaccggttatagagtctgatgttctcatgggacaggtatgaatatcgaggaaagaatacggaagtcatcctgtacccgttgcgcagttggcggtgtccactgcagaagctgtttcccgaaccgatcgaccgacgaacgtaaagcgtcgtgccatgagctc

SEQ ID NO: 2025 - protein, 526 aa, Coriolus versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 2026 - DNA, 1389 bp, Thermus thermophilus
atgctggcgcgcaggagctttctccaagcggcggcgggcagtctggtcctgggcctggcccgggcccaaggcccttccttccccgagcccaaggtggtgcggagccagggcggcctcctctccctgaagctttctgccacccccaccccgcttgccctggcggggcaaagggccaccctcctcacctacggggggagctttcccgggcccaccctccgggtccgccccagggacacggtgcgcctcaccctggaaaaccgccttcccgagcccaccaacctccactggcacggcctgcccatctcccctaaggtggacgaccccttcctggagatccccccgggggagagctggacctacgagttcaccgttcccaaggagctggcaggtaccttctggtaccacccccacctgcacggccgggtagccccccagctctttgccggcctcctgggagccctcgtggtggaaagctccctggacgccatccccgagctcagggaggcggaggagcacctcctcgtcctgaaggacctggccctccagggcgggcgcccggcgccgcacacccccatggactggatgaacgggaaggagggcgacctggtcctggtgaacggggccctgcggcccaccctggtggcccagaaggccaccctgaggcttcgcctcctcaacgcctccaacgcccgctactaccgcctggccctgcaggaccaccccctttacctcatcgccgccgatgggggcttcctggaagagcccctggaggtgtccgagctcctcctggccccaggagagcgggccgaggtcctggtgcgcttgcggaaagagggccgcttcctcctccaggccctgccctacgaccgcggggccatgggcatgatggacatggggggcatggcccacgccatgccccaagggccaagccggcccgaaacccttctttacctcatcgcccccaagaaccccaagcccttacccctgcccaaggccctaagccccttccccaccctgcccgcccccgtggtcacccgccgcctggtcctcaccgaggacatgatggccgcccgcttcttcatcaacggccaggtctttgaccacaggcgggtggacctgaaggggcaggcccagacggtggaggtctgggaggtggaaaaccagggggacatggaccaccccttccacctccacgtccaccccttccaggtcctctccgtgggcgggaggcctttcccctaccgggcctggaaggatgtggtcaacctgaaggcgggcgaggtggccaggcttctggttcccttgagggaaaagggccggaccgtttttcactgccacatcgtggagcacgaggaccgggggatgatgggagtcctcgaggtgggttag

SEQ ID NO: 2027 - protein, 462 aa, Thermus thermophilus
MLARRSFLQAAAGSLVLGLARAQGPSFPEPKVVRSQGGLLSLKLSATPTPLALAGQRATLLTYGGSFPGPTLRVRPRDTVRLTLENRLPEPTNLHWHGLPISPKVDDPFLEIPPGESWTYEFTVPKELAGTFWYHPHLHGRVAPQLFAGLLGALVVESSLDAIPELREAEEHLLVLKDLALQGGRPAPHTPMDWMNGKEGDLVLVNGALRPTLVAQKATLRLRLLNASNARYYRLALQDHPLYLIAADGGFLEEPLEVSELLLAPGERAEVLVRLRKEGRFLLQALPYDRGAMGMMDMGGMAHAMPQGPSRPETLLYLIAPKNPKPLPLPKALSPFPTLPAPVVTRRLVLTEDMMAARFFINGQVFDHRRVDLKGQAQTVEVWEVENQGDMDHPFHLHVHPFQVLSVGGRPFPYRAWKDVVNLKAGEVARLLVPLREKGRTVFHCHIVEHEDRGMMGVLEVG

SEQ ID NO: 2028 - DNA, 2510 bp, BACILLUS HALODURANS
gaattcacaggagttagaagaagtccaagatcatgaagaatttcttcgagcattgcaaaccgtagttcccgagacgtaccaaaagggagaattggcagagatgtacaccgactggcgagtcatcactgcccttccttttcccaaaacggtaggaagggaacaagacgaaatttattatgaaatggcgaaaaacttttgtggaaaagaagttgctgaaaaatcttggcttgcaaggttatatttcccgaaatgggaaggcacaagcgtcagtgcgttagaaggacaaattttcgtagcaaaaagtcagcaacaaggatggttcgtctggtttcaatatcattaaaaacagcttgaaaagtgttaaaccttagtcctcatctttttcccggactaaggttttttgatatgaagaaatcaaacttcttcatattttctataaattttttggttatagtgtagtcaagctatatcaagggaggaagaaatatgaaaaaatcatatggagtgatgggaggcgtccttgctgtcttcttcgcaatagctggctgttcatccgacgatcattctgaaatggatcacggtaacaatcagcaagatgaacaaaatgaagggacatttgaagatgggaagaaagtgttcaacctcgaggtaacagaaacacattggatgtttaatgacgaggtgatgatggatgcttggacttacaatgggacgttaccagggcaagaaatcagagtccaagagggagatgaagttgtcataaacgtgaaaaactccctcaatgtcccaactgcccttcatttacatgggtttcctgttccaaatgaaatggacggagttccgggcgttacgcaaaatgcgattatgccaggtgaagagtttacgtatgaatatcaagcaaatgtaccaggaacttactggtatcattcacaccaagacggggcgactcaagtggataggggtctttacggtgtttttattgtggaaccagtggacccagagtcttatgatacagatgtagctatcgttatagacgagtttgcttctatgggaatgggtatgggtatggatcacagtaccatggaccatggagatatggaacacgacgggaacgacgacatgtctcattcagaaatgatgaatgagatgtatgacacgatggtaattaacggaaaggccgatccacaaatagaatcgatcaatgtagtagaaggaaatagagtgaaacttcgttttgtgaatgcagggttgtttacacaagtggtatctataccagagcactcctttaaaatcacgcattacgacggtcaacctgtaaacgaaccggatgttttacaggatacggccttccgtatcgcaccagccgaacgctacgatcttgaaattataatggataaccctggagcgtggggcattcaagtatttgctgaagaaaatcaagagcgactacaagcgttaattcctcttgtatatgaagagtatgaagacgaagaattacaaacagtcgattccatttcctcattctttgatttaaccacgtatgggataccgaaagaattggacataggagacattacaaaagaatatgacatgctccttggatcagatgatggtggtgacacctttacgattaacggaaagaaatttccaaaccatgaaatatacgatgtcgaagaaggggatgtggtaaagttcacgatcatcaacgatacagatttcgaccatccgatgcatttgcatggggatttcttccacgtcatttccaagggcgggaaggctattcaaggctctccggttttaaaagatacgctcaatgtcagacctggagaaacgtatgagattgtatttgaagcgaaaaatcctggaaactggatgtttcactgtcatgagtttcatcatgcaagcggtggaatggtagcagaaattcattatgaagggtttgaacttccatttacgccagatcctaatattccaaatatgcctgagtaagtatgaaaactttcattagagtgataccaaaaatcaagtgtatgatcttttttagtatcactgacagattgctgtcaggttattgttgttaccataagcctgtaagcaaaatcaattcccaaaaaggagcttgattatgacaaacaataacccaaggattcaaccggttccagaaggctaccattcagtcactccatagatgatctcaaaaaatacagagcagcttttaacattcgtaaaagaagtatttcaagcggaggaaatcgatcgttttacgaacgaggacgggtcgatcgggcatgcggaggttcggattgggaactcggttattatgatgtttgatgccaaaccagaatggccagataccccatgttttcttaggttctatgtggaggatggcgataaagtgtttgaacaggcgttaaaagcaggcgccacccccgtaactgaattaaccgagttgtttttcggagatcgcgttggccgcgtcaaagacccattcggaaacatttggtgaattc

SEQ ID NO: 2029 - protein, 500 aa, BACILLUS HALODURANS
MKKSYGVMGGVLAVFFAIAGCSSDDHSEMDHGNNQQDEQNEGTFEDGKKVFNLEVTETHWMFNDEVMMDAWTYNGTLPGQEIRVQEGDEVVINVKNSLNVPTALHLHGFPVPNEMDGVPGVTQNAIMPGEEFTYEYQANVPGTYWYHSHQDGATQVDRGLYGVFIVEPVDPESYDTDVAIVIDEFASMGMGMGMDHSTMDHGDMEHDGNDDMSHSEMMNEMYDTMVINGKADPQIESINVVEGNRVKLRFVNAGLFTQVVSIPEHSFKITHYDGQPVNEPDVLQDTAFRIAPAERYDLEIIMDNPGAWGIQVFAEENQERLQALIPLVYEEYEDEELQTVDSISSFFDLTTYGIPKELDIGDITKEYDMLLGSDDGGDTFTINGKKFPNHEIYDVEEGDVVKFTIINDTDFDHPMHLHGDFFHVISKGGKAIQGSPVLKDTLNVRPGETYEIVFEAKNPGNWMFHCHEFHHASGGMVAEIHYEGFELPFTPDPNIPNMPE

SEQ ID NO: 2030 - DNA, 1749 bp, COLLECTOTRICHUM GLOESPORIOIDES
aaaccacaagagctatcctcacccaacaggaattacccgccggaaacagccataagccgcagcaggcccctcattccagacctcgagctatctttcctgatgctaggtcttgtcccgaggctcgccccctttttctgtctggcttgctattgctacaactagagggattgcggagcgtcttccgaccatacccaatttgatggaaacttgcgaaatggcgaccctcacgtggcatcgtgggccttggaacgcccagctcaccgactctggaattttggtgatggggattgcttcaagatgcgactggcggaggaataacggagtccatgactctgattgagggaaccttgttgacgagcgattttgaggatcagggtcagctaggttagtcgctgctttcaggcatagatcgaagctcgtgaaggatcaaagtcgtcagggttctcgatgggatgaactggcatgtcactttgacatctgttcctcatcgtgaactcattgagcttgcatgagttctcttgcgagatatcgtacttctcatcgtttgatcaactgcaagagatcttgtacttggtacatctcacggatcgacctccgcctgttatgaagtgtcaactgtaaggtcgaaacgatgacaatcgtggaaaccaaacaacataaatagggcctcacgatcctctcaaacacggctttcttttggatcatcagactcaagccctcgctcagactgacagctcctccttctccttcgctccaagccgacgcagcacattctctcagagacacctctcttcatacgacgccccgtccccaaacatccaaaatgaagttcctcagcgtcttgtccctggccatcaccctcgccgccgcggctcctgtcgaagttgagaccggcgtcgccctcgagacccgtcagtcgtccacccgcaacgagctcgagaccggcagcagctccgcctgccccaaggtcatctacatctttgcccgtgcctcgactgagcccggtaacatggtaaggcttccttcatcctatcttcaaaggcctatactcacatttcgaaaagggaatcagcgcaggccccatcgtcgccgacgccctggagagaatctacggcgccaacaacgtctgggtccagggcgtgggcggcccctacctcgccgacctggcctccaacttcctgcccgacggcacctcgtcggcggccatcaacgaggccagacgcctcttcaccctcgccaacacaaagtgccccaacgcggccatcgtctcgggcggctacagccagggcaccgccgtgatggcgggctccatctcaggcctgagcaccacgatcaagaaccagatcaagggcgtcgtgctcttcgggtacaccaagaacctgcagaacctgggccgcatccccaacttcgagacgtccaagaccgaggtctactgcgacattgcggatgcggtctgctacggcaccctgttcatcctgccggcgcactttttgtaccagactgatgcggctgttgcggccccgcgcttcctccaggcccgcattggttaagagggttgaaggagaaccgaaattggggttagagtcgaataagcatggcgggatcgaggggaaggtgtttttggttgcggctgttgatcggtcagggggaggagttggctgagcttggtgctctacattcaattctgtcactcacttcgtcattcgctttttatcactcgctaagtacatgatgcttctggatagctgc

SEQ ID NO: 2031 - protein, 218 aa, COLLECTOTRICHUM GLOESPORIOIDES
MKFLSVLSLAITLAAAAPVEVETGVALETRQSSTRNELETGSSSACPKVIYIFARASTEPGNMGISAGPIVADALERIYGANNVWVQGVGGPYLADLASNFLPDGTSSAAINEARRLFTLANTKCPNAAIVSGGYSQGTAVMAGSISGLSTTIKNQIKGVVLFGYTKNLQNLGRIPNFETSKTEVYCDIADAVCYGTLFILPAHFLYQTDAAVAAPRF

SEQ ID NO: 2032 - DNA, 2375 bp, Fusarium oxysporum
ttttagtgtccgagcacaagaagatcatcagttcataccgagtcatgagcctcacttgtccaagcccaagggatcaaaacatgccagtttcaactacaatacgagagcgctaaaacctgttagactgaaactagaagtcaaagtcaccttgacctcgtcgacaaccaatctatcgaaaactcaaattcccgtcaacgaggcgcctgttttaatgctctagcgttgaactacccgcaatctggcacttgcgtagccaatacaaccttgcacttgcgcaaatagcgtgcatggaacttaccgaaccgaggtcattttcaattcctgacacccaagactcatcaaacttggactggtatgggctgaccacgttagcgggttttagtatgaaaccgggaataaatgcgcactgccaccactcccctgaggccaccatttctgtggtttcaggtccctgtctaaaaaagcaactgtcaaagcggcgcacaccggttcccagcaacgtggtcatagggcgccgtttcatactgtatattgactgtttcgatgatcagtggagtttgctcgactgggcgcaacggggctcatttcccgttttgatgagggcttgcgaagagactactggttttggcggcggcaggcaagggcttctcgcatgactcgggagttgagattggtgggacgcatggtgataggtttgagaacgaatgggtttggtggtgtgtgctcttaatttgtttccgggagatagaggttgcttgatctttgcttcttgttctttgacctgatggtaccgaaagcgatcccatcgtctgtactctgagttattccaaaagcgttagacttgcgaaagcacagaagatggatgtttctttggactttttagataaatacctgggatggcctcgatgttgatgggatgaatcaagcctctcagtcactcactcaacagcctctctttcaaatccaactcaactgtcttcgattcttcttacttctctcgcctcaaccgccaaaatgaagttctccatcatctctactcttctcgctgccaccgcctctgctcttcccgctggtcaggatgccgctgctctcgaggctcgccagctaggcggcagcatcacccgcaacgatcttgccaacggcaacagcggttcatgccctggcgtcatcttcatctacgctcgcggctccactgaatctggcaaccttgttagtgcccttttcacccccactaaccgcccaagtgacagattataactaactcttttattaagggaactctcggtccccgcgttgcttcaaagctcgaggccaagtacggcaagaacggtgtctggatccagggcgttggcggtgcttaccgcgctactctcggtgacaacgctcttcctcgtggaacttctagcgctgctatccgtgagatgctgggccacttcaacgacgctaaccagaagtgtcctgatgctgttctcatcgctggaggttacagccagggtgctgctctcgccgctgccagtgtcaccgacgtcgaccccggtattcgggagaagattgctggagtcgttctcttcggatataccaagaacctccagaaccgcggaaagatccccagctaccccgaggaccgcaccaaggtcttctgcaacaccggtgatcttgtctgcactggttcgctcatcgtcgctgctcctcacttggcctaccagagtgctgcttccggcgctgctcctgagttcctgatccagaaggctgatgctgctggagccgcttgagcgagttgatggagggagaaggactaggctggcctgttcttgtattttatgaggtttacggttttcattagtttttgtttgtatctacttcatggaggaatggctttagtgaccatggacactgagactcaatacgatagcgcaatcgcattgacttgcaaaaagcttcttcccgggaatgcgaactgccgtgacaaattgctgaccattatcatgacgcaagaggaccgttgagaaaagatgatattcgatatatcatattctcagaacatggatcaatacgagcaagcaacatcgcaattggtggtttcgtcccatcttgtcccctgtatgttgtatcggaagtgtctgaggtgccgaccaggggttccatgctgcaggggttagcatgcacgcattgcatatgttaggtcacatgtgacgatacatctgacagtgggggaattgccaagcatgataggtacacttgtgaggaaatacttgttcggtaactgcgagatctgacttcacttgcgacaaactctcacattggaagaatcagcttttgcgtgggattcacatttcctatttgcatcagcatcatcacctggtagtggggggccg

SEQ ID NO: 2033 - protein, 230 aa, Fusarium oxysporum
MKFSIISTLLAATASALPAGQDAAALEARQLGGSITRNDLANGNSGSCPGVIFIYARGSTESGNLGTLGPRVASKLEAKYGKNGVWIQGVGGAYRATLGDNALPRGTSSAAIREMLGHFNDANQKCPDAVLIAGGYSQGAALAAASVTDVDPGIREKIAGVVLFGYTKNLQNRGKIPSYPEDRTKVFCNTGDLVCTGSLIVAAPHLAYQSAASGAAPEFLIQKADAAGAA

SEQ ID NO: 2034 - DNA, 648 bp, Neosartorya fischeri
atgaacctgcgcctattgacccttgccctcgccggcctcgccgccgcaagtccagttgccatccaggagagacaattttcctccgggaacgaactccgcgatggagcctgcaagcccatcaccttcatcttcgcccgtgcatccacggagccagggctcctcgggatgtccaccggcccagcagtctgcaacaacctcaaagccgccaaaccagggcaggtagcctgccaaggcgtcggaccagcctacacagctgatctggggtccaacgcactccccgagaacacctccccggcagctatcaatgaagccgtggacttattcaagcaagctgcgtcgaaatgcccagatacgcagattgtagctgggggatacagccaaggcacggcggtgatggacgggtctatcaagcggcttcctgacgaggtcaaggagaagatcaagggtgttgtgctgtttggatatacgcgcaatgcgcaggagagggggcagattgccaatttcccgaaggacaaggtcaagatttactgtgctatgggggatttggtgtgtgatggcacgttgattgtgacggcggcgcatttcacgtacggggcgaatacgggcgatgcggcgcggttcttgctggggaagttgtcgactgcttga

SEQ ID NO: 2035 - protein, 215 aa, Neosartorya fischeri
MNLRLLTLALAGLAAASPVAIQERQFSSGNELRDGACKPITFIFARASTEPGLLGMSTGPAVCNNLKAAKPGQVACQGVGPAYTADLGSNALPENTSPAAINEAVDLFKQAASKCPDTQIVAGGYSQGTAVMDGSIKRLPDEVKEKIKGVVLFGYTRNAQERGQIANFPKDKVKIYCAMGDLVCDGTLIVTAAHFTYGANTGDAARFLLGKLSTA

SEQ ID NO: 2036 - DNA, 1029 bp, Neosartorya fischeri
atgaaggtatcagccaccaccgttgtcctcctcgctgggcttgccgccggtgcacccactaaaaccattcactccgagcttgagaagcgtcagttcggcaccggcacggatggactgggtgctctggcctctatcttccctatcctgggcggtggcggctcttccacctcgtctggtcttggtgctctggcctcgctcatccctggtctgggcggctcctcctcgtctggaagcggcttcagtcttccgggattcaccttgcccacctccatccccggcctgggcagtctaggtagcctgggtagctccggctcttcctccggcgcttctggtctttcgggactgagcggactcggcggcctcagcggcctcaacggactgagcgcaagcaccaccgactctagcgccgaggcaagcaccagcggtaccgccgccaccagctccgattccaactcgggcgtcgccctctccggcctcctcggtggctccatcaccgaaaacggcgtcaaaaacaaagacgcctgccaacccctcaccttcatcttcgcccgcggcacctccgaactaggcaacatgggctctatcgccggcccgcccgtcgccaccaagctccgctccctcctcaacaacaaggtcgtcgtgcagggcgtcgactaccccgcctccatcgaggggaacgccatgctcggcgcggctggcggacccacaatggccagcctggtgaagcaggctctgtcgcagtgtcccgataccaaggtcgtggtgggcggttactcgcagggcgcgatggtcgtgcacaacgcggcgaactcgttgagtgagggccagattgccgcggcggtgctgtttggcgatccgttcaagtctcaggctgtgggcaaggtggacaaggcggatgtcaaggagtactgtgcagctggggacccggtttgtctgaatggggtgaacgtgctggcgcatttgagctatggcgatgatgcggccgaggcggcgcagtttttggttacggcttcgggggttaaggcttag

SEQ ID NO: 2037 - protein, 342 aa, Neosartorya fischeri
MKVSATTVVLLAGLAAGAPTKTIHSELEKRQFGTGTDGLGALASIFPILGGGGSSTSSGLGALASLIPGLGGSSSSGSGFSLPGFTLPTSIPGLGSLGSLGSSGSSSGASGLSGLSGLGGLSGLNGLSASTTDSSAEASTSGTAATSSDSNSGVALSGLLGGSITENGVKNKDACQPLTFIFARGTSELGNMGSIAGPPVATKLRSLLNNKVVVQGVDYPASIEGNAMLGAAGGPTMASLVKQALSQCPDTKVVVGGYSQGAMVVHNAANSLSEGQIAAAVLFGDPFKSQAVGKVDKADVKEYCAAGDPVCLNGVNVLAHLSYGDDAAEAAQFLVTASGVKA

SEQ ID NO: 2038 - DNA, 1686 bp, PYRENOPEZIZA BRASSICAE
aattcaaaggctggaatggggaagccgtgccgatccttgcgtcggtgccgtgccgtaggatacatcaaacgacacttgcagctttattcgatcacatatcaagcagaaactttatcatgcaacaggaataaaacgagtacgctgcgggatgtcatcacccaccagccttgtattacagatgtggccgatgcgatgatattaatcttctgatgtcgcagaagtgatgccaatgacattgaagtatgcctccccaataagataaatagtagtaataatccgtagtcgaaaatcatttggcatcagcttcatacttaatctacactcacgacaccaatcgagatgttaccaatcaatacccagtccctcctcttcctctcacttctgtccactgttttctcatcacctatcgccaacccacaaacaaataatgccatcccccaatcgacagacacaacagccatggctcaagcggccgcactcgaaggttcaaagcaagccaccgtcgaccgcgcctcaacgagtatcgtcaacgggcttctcgcagccgtcggcatggctccagtaactcaacatgaaagtaacagctctcggcaacactctcacaggtttcggacaggccctagccacaaccctaggagttgacactacatcctcgtctccgaattgcgctgagatgatggtggtttttgcgagaggaacatccgaacctggcaatgtggggttgttttctggacccacgttttttgatgctttggaggttatgatgggggctggtgctgtaagtgtgcagggtgtggagtatggcgcttctattgaagggttcttgcaaggtggggatccggctggaagtgcggctatgtaagtcattctggaaagtgtgtcgtgctcttaataatttgaaatagggcgggaatagtcgaaggcacagtacagaattgccccaacgcaaagatcgtcatgtcaggatactcgcaaggtggacaacttgtacataatgcagcggccatgctccccgctgccacgatggcaaagatcagctctcttgtcatttttggagacccaagtaagttcttctgtaactttttctcttatctcaagctaacaactctgcagatgacggaaaaccaatcgccaatgctgacccctcgaaggttatggtcgtctgccacccaggacataatatctgtgacggacgtgacttggtattggtcgagcatcttacctattcgagagacgccgtcgaggccgcgacatttgctgctgctcgagcgaaggcatgaacatagtcaaagaaatgagaggagaataatacggaactgtaccaccatgatatcagtgagagcgggaaacaattgtgccaatattcacgactggcgtcgaagtttgaggagttatttagcgatcttcaaggttgtataataatttaaaacatcaattctgaagccatgtgctgcttccttctgtgcttttttggtgtatcttcgctgcactttgggcaatcttaaaatttgaagtatggtagtaccttcggattcgaactgggaagtataaatgcaaatttggttcacaaaattagagatttattgcaatttatctccataaggtctcaaccataaccactaacttttatccaaaagtgacatttttgttgaggtcactgctccaagtacagcgcattttcggtta

SEQ ID NO: 2039 - protein, 203 aa, PYRENOPEZIZA BRASSICAE
MKVTALGNTLTGFGQALATTLGVDTTSSSPNCAEMMVVFARGTSEPGNVGLFSGPTFFDALEVMMGAGAVSVQGVEYGASIEGFLQGGDPAGSAAMAGIVEGTVQNCPNAKIVMSGYSQGGQLVHNAAAMLPAATMAKISSLVIFGDPNDGKPIANADPSKVMVVCHPGHNICDGRDLVLVEHLTYSRDAVEAATFAAARAKA

SEQ ID NO: 2040 - DNA, 2848 bp, Botryotinia fuckeliana
aagctttctcaatatggggtagccttatgtcccttcccttgtccttgctgtcgatctcaccattttccatttctcttcacctctttctcctccgtgattcaaccacacctcttagaatctttaatgcctcggcagttgaagacatacacgggcctcgtcaattatcgcacattgtactactcaccaacttaatgaaatactggcatctaaacacggtattcaaaagatgcgagatgtacagacagacactcgcaggtcatgacaaattccccgtcggacttccacattggaattttgagagtccaagcaaaaaagttacaatggtgttatgttgcatcacaatcaaaatcttccttactttttctccacacaggcaccaccatcctccttatgcttctttcatccttaacgtttcaaaaagtcggattcatctgaaaaagttacatcaaaagcaatttttcgtctcatactaattgatatattggcaaaataatcaatgtcaagtcgaggtatccacttcaaaaggtatcaaagcaccaatatcccggctaccaacatgtttaagccccgccaaaacataacaaaacggtctaaagatctaggaaacgggaggtgatatgccaagtggagatcctttgtaccaatcgcatctcaagaatgtttttgcaactctgccataagcgccgagcatgtgctttgttcttctccccagatatatcgtattaacgtctattttccgtcatccctaaattgggattgtactgccggggaagtttcccaagatgtcgattccaggtccgatgaataactattctggcatcgatgcgaggctagtgcagctgcagttggttgaagtgcctgtccaagctagagccttaattattagcgcatagaggaaaaagctcggcttagaggtctagtgatcatacacagagtcgaacattcattgagataacagtactgtaccccatattgaagggtaatcattgctaaattggttttcatgaggagctgtgtggagctcaccaccgctatttctcctcggcacttctacttttttaataatagaaacgttgttataaccttcgtctggtgtgtgatagcatctaggactaagcccggtcggttgtcatctggtgtgttgaatacctcggtatttagcaagtttcatcttgactggccgacaagcatctagatactattatcggcttgaaacttcatcccaaggcctccgaggaattaagcatatgttatgatctcacggtgttccccacaaaaataaatgacgttcctggttgtcgggttcaactttgaagatataaagtcaagatgatttcctttcaacgcaatttctctcatcactgatcatcgtctatacattctttcactgatatcttcactaatccttctattctcattcgactactcattattcattgtacaaaatatcaatacatcaatttcaaaatgaagacctcagctcaacaactcttgtccgctctcctccttcctctctccgtcttagccgctccaacaggttccattgaagctagagcatgctcagatgtgacggtcatctttgcccgtggaacgactgagactggaactctcggtactgtagtcggaccacccttcctcgccgctctcaaatctgctcttgggtcatcttcagtcaccatgaatggtgtcgactacccagcagatgttccaggatttttgcaaggaggcgatcctgctggcagtcagactatgtatgttttctttttctgagatttcagcgtgactagttgtttttcctcttaaaaacatttactcacatctcaatacagggccacaatggtcacatcaaccttatccagctgcccagacacaaaactcgtcatctctggctactcccaaggtggccaactcgtacataacgccgccaaacttttaccagccgaaacaacagctaaaatcagctctgccgttatcttcggtgacccaggttcgtcccaacccctttacatattccacaatatggcatgaaatctgaaactaacacaattaccagacaatggagatccagtccaaggtgtctcagccgatagaacagatatcatttgtcacgctggagataacatctgtcaaggcggaagcttgatcttactggctcatctgacttatggaatggatacgacggcagcagcggcatttgttaagaaagcagccggattgtagggcggatgagtatccgcagtgcggattggattggatggagttacttggaatgatatgatacgacatgggcagcccttcattctcgaaattgggcatggagtttttacgtttctggcagtaaaggcttttctggtacattttacttcttttctccctactggactttcctggctcttcttttcctgttaggcaaacagcacttcaattgggatgagctatctcgactgtagagattctcgtcagacggtattggattggctaggccagtagggggtttacttatatttcgcttccttgcttgcaggtcagcatttttattttacacacatcaaatatcaaatatcaaaaggctggttcgagaatggtttataatctgaattgacattctctgcgaatccgtttatgacttgtgatttgagctatcttctttggtggatcaatagaagagaaaaagccgagatattgacttaattatctcatttacatattggaataagtcacatacgaattacaaaagatataaggagatgctagttttgcagggtttgaagtattaagttagatatagcttaccctcctagtagttgaacctgtatacgtgattaagagtagcagtcgcaagaattcc

SEQ ID NO: 2041 - protein, 202 aa, Botryotinia fuckeliana
MKTSAQQLLSALLLPLSVLAAPTGSIEARACSDVTVIFARGTTETGTLGTVVGPPFLAALKSALGSSSVTMNGVDYPADVPGFLQGGDPAGSQTMATMVTSTLSSCPDTKLVISGYSQGGQLVHNAAKLLPAETTAKISSAVIFGDPDNGDPVQGVSADRTDIICHAGDNICQGGSLILLAHLTYGMDTTAAAAFVKKAAGL

SEQ ID NO: 2042 - DNA, 1662 bp, Ascochyta rabiei; identical to SEQ ID NO: 302

SEQ ID NO: 2043 - protein, 223 aa, Ascochyta rabiei; identical to SEQ ID NO: 303

SEQ ID NO: 2044 - DNA, 672 bp, Aspergillus terreus
atggccctcagcagaatgtccctccgctctgttctcgtcgccgcgctggcggcgctggccgtggccacgcccgtgcccgagaactccctgcaggagcgccagctcatgagctccaacgacgtcgaagacggcgtctgtcgcgatgtgaccttcatctttgcccgcgggtccaccgagcagggcaacatgggcttcgtcgtcgggcctgaggtctgcacgagcttgaaagctgatctcggctccggcaaggtcgcctgccagggcgtgggcggcgcatacacggcctcgctggcgcccaacttcctgtctgccaatacagacccacagtcgatccaggcggcgacggacctgttcgagaaggccgtggccaactgcccgaacacgcagattgtggcgggtggatacagtcaaggctccgcggtgatggacaactcgatccaggccctccctgccgacatccaggagaaagtcaagggcgtggtcctctttggcttcacccgcaacctccaggacaacggacagatccccaactaccccaaggaggatgtcaaggtttactgcgccctgggcgatttggtctgcagtggcacgctcatcatcaccccggcgcatatgacatacggggtcaatgcgggcgacgccgcccagttcctggcctccaaggtgcagtaa

SEQ ID NO: 2045 - protein, 223 aa, Aspergillus terreus
MALSRMSLRSVLVAALAALAVATPVPENSLQERQLMSSNDVEDGVCRDVTFIFARGSTEQGNMGFVVGPEVCTSLKADLGSGKVACQGVGGAYTASLAPNFLSANTDPQSIQAATDLFEKAVANCPNTQIVAGGYSQGSAVMDNSIQALPADIQEKVKGVVLFGFTRNLQDNGQIPNYPKEDVKVYCALGDLVCSGTLIITPAHMTYGVNAGDAAQFLASKVQ

SEQ ID NO: 2046 - DNA, 858 bp, Aspergillus terreus
atgctgtggaccctatctatcctcccccttctggggcacgccatcgccagcgccgtgccagctgaaaagcgccaaagctgcccgggagtgcatgtctttggcgctcgcgagaccaccgcgtcaccaggctacggctcctccagcacggtggtgaacctgatcctcagcgcatactcgggctcgaccgccgaggccatcagctacccagcctgtggcgggcagtcatcctgtggcggcgtgagctactccgcctccgtggccgcgggcattgacgccgtggcgtccgcggtaaactcgttcaacacccagtgtcccagcacgcagttggtgctggttggatactcccagggcggcgagatcatggacgccgcgctctgcggtggaggcgtccccaaccagggcgtcaccaacacggccgtgcggctgtcgtcctccgccgtgaacatggtcaaggccgccatcttcatgggcgatccactcttccgcgccggtctgccgtatgatgtcgggacgtgcagtgctggaggcttcgatgcccggccggctgggttctcttgcccctccgccagcaagattcagtcgtactgtgatgggcccgacccgtactgctgcaatggaagcaatgcggcgacccataatggatacggtgcggagtatggccaggcggcgctgacgtttgtcaagagcaaattgagctcgagctcgtctgggggtggctccactggaggggggagtggctctggcggtactgttgcgcagtatggacagtgtggtgggcagggatatactggggcgactacgtgccagagtccgtatacgtgcactgtgatgaatcagtggtattctcagtgcttgtag

SEQ ID NO: 2047 - protein, 285 aa, Aspergillus terreus
MLWTLSILPLLGHAIASAVPAEKRQSCPGVHVFGARETTASPGYGSSSTVVNLILSAYSGSTAEAISYPACGGQSSCGGVSYSASVAAGIDAVASAVNSFNTQCPSTQLVLVGYSQGGEIMDAALCGGGVPNQGVTNTAVRLSSSAVNMVKAAIFMGDPLFRAGLPYDVGTCSAGGFDARPAGFSCPSASKIQSYCDGPDPYCCNGSNAATHNGYGAEYGQAALTFVKSKLSSSSSGGGSTGGGSGSGGTVAQYGQCGGQGYTGATTCQSPYTCTVMNQWYSQCL

SEQ ID NO: 2048 - DNA, 684 bp, Aspergillus terreus
atgctgtccaagctgtccgtcgttttgctagccagcagtgcgctggccgcacccagcgaacctggaaagcgccagagctgtcccaatatccatgtctttggagcccgggaaacaaccgcgccggccgggtttggcaccgccgggaccgtcgtggatttgatcctcaatgctcaccctggcgcgacgtccgaggcaattgactatcccgcagctggagacaatgcatattcgtcttccgtccagcagggtgtccaagccgtcgcgaaccaggttgctacgtttgtgggcaactgccctgacacccagattgtcctggttggatattcgcagggggcacaaatcatcgacgacgccatgtgtggtggaggtgatgcgaatatgggcatcagtgacacctctgccgccatctcgagtgatgtcggatcccatgttaaggcgatgatttggatgggtgacccccgccatacgcccggtgcgccttacaatgtgggaacgtcgactgcatcagggtttgaccctcggtctggagatctgtcttgcagtccgtataccaatatcattcagtcatactgtgaccaggcagatccgtattgctcgaacggcaatgacgggtctgtgcatcagggttatgggacggcctatggccaggatgcgctggaatttgtcaatggcctgttggcttag

SEQ ID NO: 2049 - protein, 227 aa, Aspergillus terreus
MLSKLSVVLLASSALAAPSEPGKRQSCPNIHVFGARETTAPAGFGTAGTVVDLILNAHPGATSEAIDYPAAGDNAYSSSVQQGVQAVANQVATFVGNCPDTQIVLVGYSQGAQIIDDAMCGGGDANMGISDTSAAISSDVGSHVKAMIWMGDPRHTPGAPYNVGTSTASGFDPRSGDLSCSPYTNIIQSYCDQADPYCSNGNDGSVHQGYGTAYGQDALEFVNGLLA

SEQ ID NO: 2050 - DNA, 663 bp, Aspergillus terreus
atggttgcactacatacccttctactcactgcatttgctgcagtttctcttgcaaacccaattcccgcacccgaactcgaggcgcgtcagattatcaatgccaacgatcttgagaatggtgtgtgcaagcctgtggtattgatttttgctcgtggttcgaccgagttagggaatatgggagccatcgcgggtatgccaacttgtaacgccctcaagttggcgcttggaagccagaatgttgcatgccagggagtcggaggcgcatataccgcatcgttgatccccaatttccttcctgccaacaccaaccaagcttcgatcagagaggcaactggtgtatttgagatggctcacacccgatgccctaattcgcaaatcgtggccgggggatacagccaaggctctgcggtcatggataatacaatccaagaccttccggacgtgatcaagaacaaggtgaagggtgttgtcctgtttggcttcacccgcaacttgcaggatctcggccgcatccccaactacccgaaggagcagaccaaggttatctgcgctgtaggggacttggtgtgtgttggcacgcttatcatcacgccggctcatttgacttatacattgaacgctcctgaggctgcccagttcctggcctctatggttagtgtctaa

SEQ ID NO: 2051 - protein, 220 aa, Aspergillus terreus
MVALHTLLLTAFAAVSLANPIPAPELEARQIINANDLENGVCKPVVLIFARGSTELGNMGAIAGMPTCNALKLALGSQNVACQGVGGAYTASLIPNFLPANTNQASIREATGVFEMAHTRCPNSQIVAGGYSQGSAVMDNTIQDLPDVIKNKVKGVVLFGFTRNLQDLGRIPNYPKEQTKVICAVGDLVCVGTLIITPAHLTYTLNAPEAAQFLASMVSV

SEQ ID NO: 2052 - DNA, 660 bp, Aspergillus terreus
atgattctcccctctttgttggttgcgtccctctccgctttggcagcggcaggcccagttcccccatctgcgcttgaggctcgacagtccgagagcgcgagtgacctcgagaatgggatttgcaaacctgtcgtcctgatctttgcgcgcgggtccaccgagtccggaaacatgggctatattgccggaatgcccacctgcaatgcgttgaagaccaaactggggtcggatcaggttgcatgccagggcgtgggaggcgcatacaccgcgggcctcattcccaatttcctccccaacaatacggaccaagcgtcgatcgacgaagcgacgaagatgtttgatttggcccatacccaatgcccggatgcgcagatcgtggcgggtgggtacagccaaggcacggcggttatggacggatccatccaggctcttccggatgatatcaagagtacggtcaagggcgtggttctcttcgggtttacccgcaacttgcaggacaacggccagatccccaactaccccaaggaccagaccaaggtcatctgtgcgccgggagacctggtctgcgacggaacgctgattattacccctgcgcatttgacgtatgcgctctacgcgggggaggcggcggagttccttgcttccaaggtttcagcttag

SEQ ID NO: 2053 - protein, 218 aa, Aspergillus terreus
MILPSLLVASLSALAAAGPVPPSALEARQSESASDLENGICKPVVLIFARGSTESGNMGYIAGMPTCNALKTKLGSDQVACQGVGGAYTAGLIPNFLPNNTDQASIDEATKMFDLAHTQCPDAQIVAGGYSQGTAVMDGSIQALPDDIKSTVKGVVLFGFTRNLQDNGQIPNYPKDQTKVICAPGDLVCDGTLIITPAHLTYALYAGEAAEFLASKVS

SEQ ID NO: 2054 - DNA, 768 bp, Emericella nidulans
atgcacttcaaacttctgtcccttgctgctctcgctggcttgtccgttgccagtcctttgaatcttgacgagcgccagctcggtagctcgagcggcaatgatctccgcgacggcgactgcaagcccgtcacctttattttcgctcgcgcctccactgagcccggccttctgggcatgtcgactggacccgccgtttgcaatgacctcaaggccgatgcctctctcggcggcgtagcttgtcagggtgttgggccgaagtacaccgcggggctggccgagaatgctttgcctcagggaacctctagcgcggccatcaacgaggccaaggagctcttcgaactggctgcctctaagtgccctgacacaaggattgtagctggtggatacagtcaaggaacggccgtcatgcacggggcgatccccgacctctccgacgagatcaaggacaagatcgcgggtgtcgtactcttcggcgacacccgcaacaagcaggacggcgggcagatcaagaatttccccaaagacaagatcaagatctactgcgctaccggtgacctggtctgcgatggtacgttggtcgttaccgccgcgcatttcacctacgtcgcaaacacaggtgaagcttccaagtggcttgagcagcaactcgcttccatgcccgcctccacctccacctctagcagctctagcagctcttcatctgcccctgctagtcaaaccagccagtctagcggtctctctagctggttctctggccttggtaactga

SEQ ID NO: 2055 - protein, 255 aa, Emericella nidulans
MHFKLLSLAALAGLSVASPLNLDERQLGSSSGNDLRDGDCKPVTFIFARASTEPGLLGMSTGPAVCNDLKADASLGGVACQGVGPKYTAGLAENALPQGTSSAAINEAKELFELAASKCPDTRIVAGGYSQGTAVMHGAIPDLSDEIKDKIAGVVLFGDTRNKQDGGQIKNFPKDKIKIYCATGDLVCDGTLVVTAAHFTYVANTGEASKWLEQQLASMPASTSTSSSSSSSSSAPASQTSQSSGLSSWFSGLGN

SEQ ID NO: 2056 - DNA, 666 bp, Emericella nidulans
atgagattccacaccattctcctcgcggctctggcctccctcgtcatcgccacgcccctccccagcgataccgatgtctccctcgagcgccgccagagtatgaactccaacgaccttgagaagggcgactgcaaatctgtggcattcatcttcgcccgcggctccactgaaattggcaacatgggcttcgtcgtcggccccggtgtctgtagcaacctaaaatctacccttggctccgacaaggtcgcctgtcaaggcgtcggcggcgcctacacagcgggtctgatccaaaacgccctcccggcaaatactgactcgggctccatcaaagaggccgtcaagatgttcgacctcgccgctaaatgcccggatactcagatcgtggcgggaggatacagtcagggctctgcggttattgacaatgcaatccagaagctcgatgatagtaccagggatcgagtcaagggtgttgtgctctttggtttcacgcggaatctccaggataagggccagattcccgggtacccgaaggatcagacgaaggtgtactgtgcagtgggtgacttggtctgctctggcacgttgattataaccgcatcgcatatgacgtatggcctgaatgccggagatgcagcgaagtttttggcaagccaggtctcagtttag

SEQ ID NO: 2057 - DNA, 4503 bp, Monilinia fructicola
ggatcctcatatccaaggcaaacattctattccatgatgctcaaatgtgggtcgtgttaatgccaaggaaattaaatccctcgccctcggtcccctttttctttattccctgatgatgatcaccttgattgatatttccttttttcttcgtcacctcctccatcttcatcctcatttcattccaccttcacattacatgaccaaatctctatgacagctacatcgacatgatcaccaatatcaataacgtatcaacatctaaacctacctagcatttaggatttctgagatatacgaggttttctgggtaccaggtatcttgatacctagctacctagcttcctagcttcctagcttcccagctagctagctacttggacggttggacggttggacggttggaccacatccccaaactcctatctattcgccattgtggacacctttggaatatgccttttgttcgcacggccaccgctatgctttgttgacgtttcacaccgttcgaattccgtctgaagaagcatcaaggtgcttttccttttcgtctcatattaatcgatacacttagcataaggtggtcaaaattaagttgtcttccgacacccgcattgacaactttaattgaagatgatgcgaatgatagaccatggcattagatcatatctacgtatgcatacatccacccatccttattacctgggaactctgcagcaacaaaacaaaacaaaacaaaacaaactcagatagatcaaaatcttccaacaggtcttctaatagtttagaaatgggtcgagacttattttcgccatcagctctcttgataatccttgtacacccttgaaccctgaatatacgctctgttctttttcacagatgtatcgattgcatgtttctgaaagatcttccctccataatctctgcttgagatcatgcaaccgaaaacagttttctaaggaaattgattcttcgtcatcattattgacatgtctaattcatggtagtattgatatcaaattagtcctcccgcttaaaagcctccccccagaatgagtaaacagctcggtatcgaggtctagtgatcttgtctgttgagtcagtgttgacttagttaagatattttgcatcagctcaaagatgaattattattactcaatcatctatttgagagatgcggggcttcgatgtttctgagtactattttccctcggcattttggattgtatcatgtttggtgacaaggttatcgacttttcatgatctcgagtcaattgacaaccatcggatgatttttgaagaggaaatggtatgtagaaccaagcataacctgatggtaaggactgccacctggtgttgtggatgcctcggtattttacgagtttcacctggaatggttgacaagcatctcgacagtattatcggcttgaaacttcatcccaagatctcctgaaaaaataagcatatgcgatgatctcagatctgacggtattccccacagtaatatatgagacttttgtttgttgggtcgaaagatataaagtcaccatgttctccggatatcacaacttttttttatcatcatcatctactgatcttcactctctttcacttaccagcatctacaggttctacactctctttcattctttatacacagattctacattctctctcaccaaactatccatcgaccacctcatcgatcacctcgtcgttcattcccaaaatctcaatacacaaatctcaaaatgaagacctcagctcaacaacttttgtctcttctcctcctccctctctctgccattgcagctcctacaggcgaaattgaagccagagcatgctcaacagtaaccgtcatctttgctcgtggaaccaccgagactccaacacttggcacggtaattgggccccaattcctcgctgccctcaaatcttctttcgggggaagtgtcaccatgaacggtgttccctacgcagccgacgtaccgggattcttgaaaggcggagatcctactggaagcaaggtcatgtaagttccctatactctctggtcatacatcacgaaggtttcgttactaacacatcatcacagggcaaacatggtttcctcagccctatccagctgcccaaacaccaagctagtcatttccggttactcccaaggaggtcaattggtgcacaatgcggccaaacaacttccagccgctaccaccgctaaaattgccgccgctgtcattttcggtgacccagacaacggatccccagttcaaggtgtcccagccgcaaagaccaagatcatctgtcacgccggagacaacatctgtcaacacggctccatgatcctcatgccccatttaacctacggcatggatgccaccgccgcagccgctttcgtcaagcaagttgcaggctcctaaatcggccgccccttggggtcagaagcgattgtgcggcgcgcatcggaaagaaacggactggacttcctatgatgacacgatatatgattgaaactggaatttctatgtcttccatgcggctgcggtttccgcttgcatttttgtgttttcctttgtttttttgggggttgcctggggcacttcgatactacactcgttccgttcttgaatttctcgttcttcttcctctcttgctggctttctctcttctcccccctctctctctctctccttccttcccacacctcatcatcactttctctttcagaacgtatggattggattggactggattggatcgaagggaaatagttagaaaatagcaggaaatttatatctcgtaccaatatcactccactttgagactcggtgacaattcaagacttttacaatctactcatctttatttgctttatttcttccccatgctcacttttttctccccatgaacttaggataggtataccagtattaaataaatgtattgaacgaaatcaaaccaaatgatcgtttcatattaataatcaataatcgcgttccccgccccactcttgtatgagggtgacacatgctgatacgagcacatttatgcacaagtgagaacccgatttgtattggacacctacattgacacaacgacaaatgaatcatcatcatatcaatcaccgcatgcgtgctgaagagcaaaaaatttcatcatatgatcaacaattgccaagaatatgaagctcgaaatttcatttgtattatttctttggtatagagcaaagatccgttgtatcggaacgactgtagaatatgtacctgagaattgaattttgtattatcgaggacgtgacatgagcaatatgagcaacttcgtttgagttccaaaaagatctgatccaccacccatagctaaagaaaaggaaagaaattaggagggctattaaccatgcctatgaaaatgattgtgtcctttactccttcaccccctttttagataccctatctaaatatcagtcgtctcattatcgttaaaattttctgaaaaagagagaaggaatagtcgtgatcatgaaatttacaacaagaaagctgcaagaccagcaacggccatggcaccgaaaccagcatcaaccttcatggctgcaccagtgaattgagctgggccagatgtggtagcgctagcgatgctagcgggtgtggaggccaaagtggtagctttggaagatgctgcagctgggaaagtggcaactggaacactggcaactggaatgctggcaactggaaacactggcaactggaacactggcaactgggacgctggcaactgggatgctggcaactggagaagaagcctctggagtaatttgataaactggagttccgagagaaacaactggtgccgaagaagctggtgcagatggctctggtgtgaaatatacgggggtaccgagagagacaactggcgcagaggaggctggtgaagatggaactggtgtataatacactggggtaccgactgaaacagtcactactgggattgtgacagtaccaggagcagtaactgtatgagggaccgagctgacagtgatggtagttggcgcagggcagtaagttgtcaagtacgaaagggtgattgtgcttggtgtaggttgaacggcaacaggcgaggaggggattggtgtgaagtacactggagtgccaagagatacagtcacaactggaatagtgacagtaccaggggcagtaattgtgtgaggaactgagctgacagtgatggtagttggtgctggacagtaagttgtcaaatatgagacagtgatggtgcttggagtgggctgaacagcaacaggcgaggatggaactggggtatagtaaactggggtaccaagagagacagtcacgattggaatagtgacagtccctggggcagtaattgtgtgagggaccgagctgacagtaatggtagttggtgcggggcaataagttgtcaagtacgaaactgtgattgtgggaaaggtagggacagcacytggggcggtgtcggaaggatatrctcgag

SEQ ID NO: 2058 - protein, 201 aa, Monilinia fructicola
MKTSAQQLLSLLLLPLSAIAAPTGEIEARACSTVTVIFARGTTETPTLGTVIGPQFLAALKSSFGGSVTMNGVPYAADVPGFLKGGDPTGSKVMANMVSSALSSCPNTKLVISGYSQGGQLVHNAAKQLPAATTAKIAAAVIFGDPDNGSPVQGVPAAKTKIICHAGDNICQHGSMILMPHLTYGMDATAAAAFVKQVAGS

SEQ ID NO: 2059 - DNA, 1697 bp, Nectria haematococca
ctttcttatttgcgggaacgttccatcctctggtttggcgatcggcgcgggttgtgactggaaagcggaagagcttgcagggaggggcacggaggtggtttcctgatgcgagcaggctgcctgaaactatcacgactcatagctgccagtgcatggttcagtatcaagaggcttggcatcctttgacgagaagtgcccctctctcgacggcagaaaccgaggaaatggacggcgagccgaggctcgacttcagagcttggacggcgacgattgttcatctgttcgcgcttaaataccgttgccagtccgctggggatggaactagataaccacaaatatcttcacttcgacagcaatcacttctactcttcactacttatccttcgctctttaccatcctcaccatgaagttctttgctcttaccactcttctggccgccacggattcggctctgcctacctctcaccctgttcaggagcttgaggctcgccagcttggtggcggaaccacccgcaacgatcttaccaacggcaacagcgcttcttgcgccgatgtaatctttatctatgcccgaggttcaactgagacgggcaacttggtccgtagactctgttccaatggcaacatcactctcacacatacactagggaactcttggccccagcatcgcctccaagctcgagtccgccttcggcagggacggcgtctggattcagggcgttggcggtgcctaccgagccactcttggagacaattccctcccccgcggaacctctagcgccgccatcagggagatgctcggtctcttccagcagccaaacaccaagtgccccgacgcgactctgatcgccggtggctacagccagggtgccgcacttgcagctgcctccgtcgaggacctcgactcggccatccgtgacaagatcgccgggaccgttctgttcggctacactaagaacctgcagaaccacggccgaatcccaaacttccctgctgatagaaccaaggtcttctgcaacactggtgatctcgtatgcacaggttccttgatcattgctgcgcctcaccttacttatggtcctgacgctcgtggcccagcccctgagttccttattgagaaggttcgagctgtgcgtggctctgcttgaggaggattaagatcttagcggccgggcctgttactagttgcatagtttcgagttttgtttttcttcagaatggttgaaatagattggttttggcccccaatctactacaaatcgcctatgtttcaagctaaagaagtaatgagaggtgatatacataatctattgcccaagaaacctcaaccaggcttccactccctgagccagtcgagcacaagtttcattgccctcgattgactcttgccaggaaagggtaacagacaaatcacggccctcgataaacggcgtacttatctgcacgaatggtcccgctacgtgtgcgctcaaggcgaagttggctgatttatagaccacctatcattcccaccatgcaccgctgtcccgagctcgctctctccatcaataacgccgagattggtaacaatccaggatagctcgcgatctcttttcgcttggctccgggatactcctgccagtcatgtaccaggttcatcaaggccgacaatgtcgttttccaggccggcgttcagcctcttctcgatattcccatg

SEQ ID NO: 2060 - protein, 231 aa, Nectria haematococca
MKFFALTTLLAATDSALPTSHPVQELEARQLGGGTTRNDLTNGNSASCADVIFIYARGSTETGNLGTLGPSIASKLESAFGRDGVWIQGVGGAYRATLGDNSLPRGTSSAAIREMLGLFQQPNTKCPDATLIAGGYSQGAALAAASVEDLDSAIRDKIAGTVLFGYTKNLQNHGRIPNFPADRTKVFCNTGDLVCTGSLIIAAPHLTYGPDARGPAPEFLIEKVRAVRGSA

SEQ ID NO: 2061 - DNA, 1735 bp, Nectria haematococca
tctttcttattggggggaacgtcccatcctgctggttggaggaccggggagggttgtgactggaagcggaagagcttgtaggaggggtacggaggttgattcctgatgggagaagggtcactgaaactatcacgactcatagctgccagtgcatggttcagtatcaagaggcttggcatcctttgacgagaagtgcccctctctcgacggcagaaaccgaggaaatggacggcgagccgaggctcgacttcagagcttggacggcgacgattgttcatctgttcgcgcttaaataccgttggcagtccgctggggatggaactagataaccacaaatatcttcacttcgacaggaatcacttctactcttcactacttatccttcggtctttaccatcctcaccatgaagttctttgctcttaccactcttctggccgccacggcttcggctctgcctacctctcaccctgttcaggagcttgaggctcgtcagcttggtggcggaaccacccgcaacgatcttaccaacggcaacagcgcttcttgcgccgatgtaatctttatctatgcccgaggttcaactgagacgggcaacttggtccgtagactctgttccaatggcaacatcactctcacacatacactagggaactcttggccccagcatcgcctccaagctcgagtccgccttcggcagggacggcgtctggattcagggcgttggcggtgcctaccgagccactcttggagacaattccctcccccgcggaacctctagcgccgccatcagggagatgctcggtctcttccagcaggcaaacaccaagtgccccgacgcgactctgatcgccggtggctacagccagggtgccgcacttggagctgcctccgtcgaggacctcgactcggccatccgtgacaagatcgccgggaccgttctgttcggctacactaagaacctgcagaaccacggccgaatcccaaacttccctgctgatagaaccaaggtcttctgcaacactggtgatctcgtatgcacaggttccttgatcattgctgcgcctcaccttacttatggtcctgacgctcgtggcccagcccctgagttccttattgagaaggttcgagctgtgcgtggctctgcttgaggaggattaagatcttaacggccgggcctgttactagttgcatagtttcaagttttgtttttcttcagaatggttgaaatagattggttttggcccccaatctactacaaattgcctatgtttcaagctaaagaagtaatgagaggtgatatacataatctattgcccaagaaacctcaaccaggcttccactccctgagccagtcgagcacaagtttcattgccctcgattgactcttgccaggaaagggtaacagacaaatcacgggcctcgataaacggggtacttatctgcacgaatggtcccgctacgtgtgcgctcaaggcgaagttggcctgatttatagaccacctatcattcccaccatgcaccgctgtcccgacctcggtttctccatcaataacggcgagattggtaacaatccaggatagctcgcgatctcttttcgcttggtctccgtgatactcctgccagtcatgtaccagcttcatcaagccgacaatgttgtttttcaggccggcgttcagcctctcctcgatatccccatgggcgacccgtgatgctgaccatatttccttctcaaga

SEQ ID NO: 2062 - protein, 231 aa, Nectria haematococca
MKFFALTTLLAATASALPTSHPVQELEARQLGGGTTRNDLTNGNSASCADVIFIYARGSTETGNLGTLGPSIASKLESAFGRDGVWIQGVGGAYRATLGDNSLPRGTSSAAIREMLGLFQQANTKCPDATLIAGGYSQGAALGAASVEDLDSAIRDKIAGTVLFGYTKNLQNHGRIPNFPADRTKVFCNTGDLVCTGSLIIAAPHLTYGPDARGPAPEFLIEKVRAVRGSA

SEQ ID NO: 2063 - DNA, 3938 bp, Nectria ipomoeae
agatctcatttccgggcaactgtgtaactaatccttactcattctaaaaaagccgtttttaatgcagaattcatcaaatgaaatggccttgttcaccgtcttcgtactactgtcatgatgcaacgtgctcagttgagtaatacattcttcaagggttaatgggatgtcagctagacaaggacataccaaaacgctctctcgcagtcacacctctcatgcccctcccttgtatcgcggaaaactccggaaagcatgtcgtccaccattttggggtgcgtgtcatgcagcaatgcaactgtccctcccgcgtcaaggccgtttacgaagttgttgatggcctggtgaagattttgctgtggctctggccgtctacagcgatggaggaaaatatgactaaataaccaagatatccaaggactctcatcgaatcgctattgtaacgtatataaggcggccggatgtggctgggctgcacgttggcgatggaaatgagagtatcttccagcttgatcatgttatcctaaatctcgataggggtctgctgtcctaacccctttcagacgagaagtcacgaatacatagagatgtagaaattcacacagcctcctatgatgtgcgatttggcaccatccgaggcaaactgggttggagagcggccatgtcatcagcacgatgttgaattaggcctcggcagagtcgtgcggcgcgataacgagttgccctcgccttggcgcttccaagaagaccccagtcacgtcttggaaacttagagcagtgacagggcgtcctccaatgagctcgatgctgatagccaaccgagaagccagtccgagctatcagacgaagcatctctatgtcaaacaacatgtcacgagcaaaaaaatctataccctttctgcccgtctctccacccggggtgttagacaatacaatatttctccctttactccgtgcgttgattattcatgttgcttttgcatcatattgctttgctggggtgttctcctggtgacagtgtacacctttccgttcaaggccattcgtacttctttcagtggtttcgattcacctcgacaaaagtttacgggatacaaagggaaagggcagaaaaactccaactgatgtcaaaattatggtagtgtcaggggttcgctttttggaaggggagttgtgtgacatgagaagctgaaactgaagtcaaaatgacctgtccgaataatttttgcgactgagatgagatgggaacggcataaaatcttgggcctcgttctaacaccacctcctcgttctgagtactccttgcatcaaaaaagatggttctaccccctaaaagcacagctcgaatgaaattcccatttgagtagatccaacgatgctccgtgtttctctaggtgaggtaggtaggttgacccacccatgatgagcggcagggtcaggtagggcggtagatatccgagtcgctgatttgcggatgaacgagtccaagcttggcataatctgttgatctcaaaaccctccaatcaccataaagaggcacccgtaaaagctcctgatgcctctccaccatcaggtaggtggtgtctatgcgcgctctgacaatcttcgcaaggtatgacagaataggcatggtggtttttccagggtttcatctctaaaaccaaacccacgcttgtcaaagtgacagctgaacagccgattttcgctgattgggctctttcatgtttgcggggaacgttccatcctaccggtttagcgatcggcgcgggttgcaactagaagcggaagaccttgcggggaggggcacggagtggtttcctgaagcgaccgggttgcctgaaactatcacgactcatagcctcgagcgcatggtctagtatcaagagttttgacgtcctttgatcaaaaccgcccctctcttgacgctagaaaccgaggaaatggatcgcgagccgaggctcgatttcagagcttggacgatgatagtttcatctgttcaagcttaaatatcgtcgagccagaccactgggaacgaaaccagacaacaacacatacattcaacataccttcacttcatcaacattcacttctattcttcaccgcgtccttttcgctctttaccatcttcaccatgaagttcttcgctctcaccacatttctcgccgccacggcttcggctctgcctacctctaaccctgctcaggagcttgaggcgcgtcagcttggtagaacaactcgcgacgatctgatcaacggcaacagcgcttcctgcgccgatgtcatcttcatttatgcccgaggttcaacagagacgggcaacttggttcgtagaatttgttctgattacaacaccactttcttacacatacattagggaacactcggtccgagcatcgcctccaaccttgagtccgccttcggaacggacggtgtctggatccagggcgttggcggtgcctaccgagccactcttggggacaacgctctgccccgcggaacctctagcgccgccatccgggagatgctcggtctcttccagcaggccaacaccaagtgccctgacgcgactctgatcgccggtggctacagccagggtgctgcacttgcagcggcctccatcgaggaccttgactcggctattcgcgacaagatcgccggaactgttctgtttggctacaccaagaacctgcagaaccgtggccgaattcccaactaccctgctgacaggaccaaggtcttctgcaacgtgggcgatctcgtttgcaccggtagcttgatcgttgctgcacctcacttggcctatggtcctgatgctcgtggccctgcccctgagttcctcatcgagaaggttcgggctgtccgtggttctgcttgaggaggatgagaattttaacaggcgggcctgttaatcataacgatgtttcaagtttttcttttgtggaatagccatgatggattggttcaacactcaatctactacaatgcccatgtttcaacttaaagaagttatgaatggtgatctacacatcgctttgtccaagaaatctcaaccaagcttccataccctcagccagtcgagtacaaatttcgttgccctcgtttgaatcttgccaggaaaggctgatagacaaatcatggcctttgacagacagggcacttacctgcacgaatggacccgccaggtgggcgctcaaggcaaagttcgcctgatttatagaccacctctcatccccatcatgcacatccgtccctgactcgatttctccatcaataacaccgagattggttacaatccagggatatctcgcgatacctttttgcttgatctccgtgatactcctgccaatcatgcactagcttcatcaagccaacaatgttgtttttcaagccggcattcagcctttcctcgatatccccacgggcgatccttgatgctgaccatatctccttctcaagatcatggacaggttggctttcccagttgttggcccgggctgtggccaaatatccgcaaccaggtcggagtcaaacgtgtggtggatggtcgacacgcagttctgcaccttcctctgggcatcagctgcattgtctttgttagggtacatgaatctccgttggtccattgcagtagaggcggtgaaagcgcgggccttgttttcagggacgtaacaggccaaacatgccagaatgataccgtggaggagaccggttagagtggtactatgctgacgacaggcaccaagaatgcgagaaagagctgcattttggacgttgaaggaagtttttgggaagcgtaagaccctagttgaagaggagcccacgtggccttggctgacttggaggagagtagcgatgggccgaaggtatgccatacttgcgaaaaagcaaacccgagagttatggggtgtttggccaacttctcttggggaagagggagatct

SEQ ID NO: 2064 - protein, 230 aa, Nectria ipomoeae
MKFFALTTFLAATASALPTSNPAQELEARQLGRTTRDDLINGNSASCADVIFIYARGSTETGNLGTLGPSIASNLESAFGTDGVWIQGVGGAYRATLGDNALPRGTSSAAIREMLGLFQQANTKCPDATLIAGGYSQGAALAAASIEDLDSAIRDKIAGTVLFGYTKNLQNRGRIPNYPADRTKVFCNVGDLVCTGSLIVAAPHLAYGPDARGPAPEFLIEKVRAVRGSA

SEQ ID NO: 2065 - DNA, 745 bp, Phytophthora infestans
cccacgcgtccgcccacgcgtccgctcgcaagtatcaagaacaagtctgcaacaacaatgaagcttgcttcgacctgcaccgtcatcgttggttctctccttctctccagttcagccaacgttgtccaagcccagtgctccgacgtgcatgttgtcttcgcccgtggaagtggcgagatgccaggacttggtatctgcggcgagccgttggtcagtgggatcacctcgaacctcggcggtatgagcgtttcctcatatgcggtcagctacctcgcttccatggatcaaactagcgctgggcctggcgccaccgacatgaccaaccacgtcgtgtctatcgcgcaagagtgtccgaacacggtattcgtccttggagggtactcacaaggcgctagtgtcaccgatatctcgcttggcatcaagaccatgcttggcacaggtgaatccatcccagaaaccctggcgccgcgcatcaaagctgtggtaacgttcggcaatccgcttaagctcatgggccagaccattgaaagctccagctcgacttacggctctaaggccattgagttctgcaacatgggagacccggtttgcggcaatggttttaacacgatggcccacatgacctatccgatggacagcgttcccggcgcggccgagaaagctgctgcccttagtgaagggcagcgcgagaatgctgcgcgcgtaactttgaggatggtcaaacgtcgtgtctgaaagccaacac

SEQ ID NO: 2066 - protein, 225 aa, Phytophthora infestans
MKLASTCTVIVGSLLLSSSANVVQAQCSDVHVVFARGSGEMPGLGICGEPLVSGITSNLGGMSVSSYAVSYLASMDQTSAGPGATDMTNHVVSIAQECPNTVFVLGGYSQGASVTDISLGIKTMLGTGESIPETLAPRIKAVVTFGNPLKLMGQTIESSSSTYGSKAIEFCNMGDPVCGNGFNTMAHMTYPMDSVPGAAEKAAALSEGQRENAARVTLRMVKRRV

SEQ ID NO: 2067 - DNA, 819 bp, Phytophthora infestans
ctcaattttctctcatcctgatcaagtcctcagttacacaagtgtcaatacaatgaagtttttgtcatcttgctcggtcgtcttcagtgcactcatgctgctgctcaccggtcccgtcaacgtcgccgcccaatgcagtgacgtccacatcgtcttygctcgtggwagtggcgaaatgcctgggtttggtatctgcgggacaccattggtgagcggcatcaagtccaatctcgccggcctgagtgtctcgtcctacgcagtcaactacctggcttcagtagctcaaaccagtgccggtccgggtgccaccgacatgaccaaccaggtcaaagccgtggctcagcagtgcccaaacactgtgttcgtgcttggcgggtactctcaaggggctagcgtcaccgacatcgccatcggtatcaagacgatgctcggcgtcggtgcaagtatcccggaggaattagcgcctcgtatcaaggccatcgtgacattcggcaacccgttgaagctcatgggccaaaccatcgcaagatccagccagctgtacggttccaaggcgatcgagttctgcaacttgggtgacccggtgtgtgccaacggcttcaacacgatggcccacattacgtacccaatggatgggagcgtgactaaagcggcggcccaagctgcggcgttagtgaagggcaacgcaagggcgttgcgtggatgagcagcgagaaacgctttttgtttttgtttttttgaaaagtagttgtggatgtcaagtgtggttattaaataccatgtactagctaaatgttaaaaaaaaaaaaaaaaaaaaaa

SEQ ID NO: 2068 - protein, 217 aa, Phytophthora infestans
MKFLSSCSVVFSALMLLLTGPVNVAAQCSDVHIVFARGSGEMPGFGICGTPLVSGIKSNLAGLSVSSYAVNYLASVAQTSAGPGATDMTNQVKAVAQQCPNTVFVLGGYSQGASVTDIAIGIKTMLGVGASIPEELAPRIKAIVTFGNPLKLMGQTIARSSQLYGSKAIEFCNLGDPVCANGFNTMAHITYPMDGSVTKAAAQAAALVKGNARALRG

SEQ ID NO: 2069 - DNA, 3244 bp, PHYTOPHTHORA BRASSICAE
aaagggactgcgggtgttccttccggcaacggctccaaagctgcaggtgtttcttgaggtgctgccgatggagtggcgacaggaatctccccagtaggcccagtttgagccggatcgggtgtatcagcgtgaggagccggaatgaaaggaggaggcaacgtcactggacgttgatctcccggtccggtttcacttggcttaggcagcggttgattcggaatcggagcaaccgggattggtatcatgggcgtccccacgggtacaggcgtgagaggtggatcggtcggctttgatggggtttctgctggtggagaaggcacatcagtggagggaacgaccggtggaggtgcaaacgtacttttccacagttgataagcctcgtatgcgagatgaataccaccattatccgcaatgttttcacccagcgtcaggtttccgttcactgtgccgagcacatgaccatcgtcaatagagacaacagggaaggtggagtactgagtagagagacactgagctttctctgcaaacttcgcagaaaccgaaggggtccaccacgagcggagggtgccatttgcgtcgtaattgcgtccttgatccagagcaggagattttctccgtcctttccttcgaaggtttttacacccaccatgagtggtttggctctaggagcgtcattcgaagactggcgaggcgccgaagccgccgcgacatcagtcattttcttttgaatgtgctcaagtagagcattctcatagttagagaacgcctctagacgcgcattaacagcgtcagggccttgcgaagcaagatgagagaccctttcgggtccgatcatcctgtcctaactgttgcttcatttgatatcaagtatagcatgcatattaattagtggagtaacaaacctcgattaagcataatatgcttttgagataaattcaaacgaaacggaaaagaacctcaaaagcaaacgacctatactaggctatagagggaccctttggctacatttcgacggtcgtagcttccaaaaatgccaagtacaggaaacttttttagcgtcgccgcaagacgtctcaagaaaaacaatttttaaaaacctttttaggcagtattctgttctaaaaagctgctctttcaaatgcacctagttagggctttcaaagaagtctggaacctatctaaaatagagcaatcataatttaggtaaaattgaaacaaaagtatcatttaattatgttctacctaaataaaagtatcattaagcaacgggtttgaaaacttgtttaatgaatggtacgaaaaagattggattcgtctgtactatttcgccgatacgctgcttttctgtgtccgcggtccgttcgtgtcgattctcttctgcttcttgcaaggtccccgcggatcatgagctactgtttgcagctggaactgttctgtttctgagagattttacgtactcaccagcagacccaacctgcttttacgaaacccaaacttatggtaattcacatccattccatactgagtctaagtcaatgtatccgaccgccttgactcactggaaaacagatgaggttttcttatcgctgggtatcgcctttgaatcatagtgagtcaaagcctttggccacttctatatccagttagtggcattctaacatcaacccggtaagacaagaccttcagactagggtacactgatggtgtttacacactccacaaccgtctgcttgtcgtcacaaatgtaaagcaaataattaattagaatgataactttagaggctgaaaaagcttcttcattctccattttccttcttacaactcaatccgcttcacaactcaagtgttcaagtgttccagacctggagcaatgaagttttcatcaacctgtacattgtccctggggtctttcctgttgcagctctccagtctcacaaacaccgtcaatgcccaatgctctgacgtccatatcgtctttgctcgtggtagtggcgaaatggctggatttggtatttgtggtgaacctcttgtcagaggcatcacttccaacctcggtggcatgagtgtctcatcctacgctgtcaactatctcgctgatgtcgctcagacgagtgctggacctggcgccaccgatatgactaacaacgtcgtgtctactgcccagcaatgtcccaacaccgttttcgtgcttggcggctactctcaaggcgccagtgtcactgacatcgctattggaatacaaacaactctaggctcgggtgtcaatatcccagagacgttggcaccgcgaatcaaggcggtcgtgacgttcggcaacccgttaaagatgatgggtcagaccattgcaagctccagccaaacctacggatccaaagcgattgaattctgtgctacgggtgatccagtgtgtggtggtggtttcaactttatggctcacatgatgtatccgacggacggcagtgtgacgaatgctgctcagcaggccgctgcgatggtgcaaggtggaggtggtgcggtagcagtcaggaccttgcgtggataattgcagtgactgtgttcttggagaaccagtgcacaaaacttcttccttgagtgaaacgtgcatccttgtcgttcaatacattgcgtatgttgaatcgttcttcgtttagtcttgtgctccaacaggagacactacaaaatgttcgaatgcatttagttagtatttatataagcacgtaccactcaagatatcatgcagcttgagcagcatccttcccgtggagtattcttctgttgttgttgattctcagctgctgccccggaagcgaccacagccgtaggcttcaagcaattagcaacctcacgatcgcgccacaagtcactggttgtgatcggtgagaacatcatcggcttcacaagactcagtgcaatcgcagcactctccggttgaggaatctaagcagcacaatacgtcacactcagcctcaaacaattatcgtgatatcaatatgataccaagcgagctaggcgtaccggttcatagtaaacactatcattgcggcgggagacaatgtcgagatctcgagtgataatctgctgggaccgaagaaaaatagccgctagcaaagtcacgcgctctttctcatctttgtctgtcatcatcttggactcgtacgccttttcaagtggcacaacggcttcaaaaagcgaggcagcctttctgaggtttgctacggcctgtgcacaattttgagcaccttcc

SEQ ID NO: 2070 - protein, 223 aa, PHYTOPHTHORA BRASSICAE
MKFSSTCTLSLGSFLLQLSSLTNTVNAQCSDVHIVFARGSGEMAGFGICGEPLVRGITSNLGGMSVSSYAVNYLADVAQTSAGPGATDMTNNVVSTAQQCPNTVFVLGGYSQGASVTDIAIGIQTTLGSGVNIPETLAPRIKAVVTFGNPLKMMGQTIASSSQTYGSKAIEFCATGDPVCGGGFNFMAHMMYPTDGSVTNAAQQAAAMVQGGGGAVAVRTLRG

SEQ ID NO: 2071 - DNA, 3857 bp, PHYTOPHTHORA BRASSICAE
tgcactcgttgtaccaagtgtgcactcccagatctaaaagaaagcattgtatcagtatttgaagtttgataaatacaaaaataaagacacccttccttctagcgggacatacaatgggtacaagctgtcgtactcgatgtccttcgagttgctgaagtacttgactgcctgtagtaaatagtgatagattagttattcagttaggagcagtgaccagagcaggtaggctaaggagccagtctggccgatgtgcgtggccgagtagaacagagtggcgcatataagtaggttcttgccggcgtagggacgaacgtgcgtgcttgggtatggaggcgtgcaggtcgctcagcgagaagtacggccagacagcaccgcaccgtataatatctacacctacctcctccagtgttatccccccgcctcgactatatattcgctgaccattcgttagcctctcctttctgggagcttctagctgcagcaaacgacgatgttattatctaggtagataagccataacaatacatgtagtcaacctttacgcgatccttcttgtctcgacggcggtcggccatgatagtgagttccgaagtgagcgctggaaaatctgtggaaggtagccagagtggcttcagatgatctttactgcactgattctggcgagttcaaggtgcgcatcacgtgcgcatcacccaattcgtaatgtataatgtaaatttcaacacattccagaggattcgatctgttttaggagggagccagcctcatggccataatttaccccttgacctaccccaactcccgcgatattactggatgaaacaaaagaaggtgtcctggagcgactcttcagcccaaaggaggcaaattgcccccatcgagggggtcaaaatatatccacttttacaaacaccctcgatgggggcaatttgctacctttgcatgcgaaagggttaatagtacgttgaccgcaatcgaaagctgttaacagagagctaccaatagtagcctatagtacggtagaacgtaggccagatcatccgtacaagaacgttgcccgtgatcatcaatgaaagcattatgaatcagtatagaaaacaaataatttaacaccaaatagaaggccaaattaactactgcatcatgaatcaggacgagaaggtcaagccgagtgatgcgtgaagagttttgtgtgtggtggtggcaacaaggaggctttgtgtgtctgtgctgcaagacgaaaactgaccggtagaaactctccatgaaatattgacgaggcggtggtgaagtaccctccgactctttctatgctgaagcaagagcgtgaaattggagtcagctgcactcccgcttcagaagcagcacatacacgtagttgcgtacaaaagcgtcacgatagcggtagatcatgagctactgtttgcagctgaaactgttctgtttctgagagattttacgtactcaccagcagacctaacctgcttttacgaaacccaaacttatggtaattcacatccattccatactgagtctaagtcaatgtatccgaccgccttgactcactggaaaacagatgaggttttcttatcgctgggtatcgcctttgaatcatagtgagtcaaagcctttggccacttctatatccagttagtggcattctaacatcaacccggtaagacaagaccttcagactagggtacactgatggtgtttacacactccacaaccgtgatctgcttgtcgtcacaaatgtaaagcaaagaattaattagaatgacaacttttagaggctgaaaaagcttcttcattctccattttccttcttacaactcaatccgcttcacaactcaagtgttccagacctgcagcaatgaagttttcatcaacctgtacattgtccctggggtctttcctgttgcagctctccagtctcacaaacaccgtcaatgcccaatgctctgacgtccatatcgtctttgctcgtggtagtggcgaaatggctggatttggtatttgtggtgaacctcttgtcagaggcatcacttccaacctcggtggcatgagtgtctcatcctacgctgtcaactatctcgctgatgtcgctcagacgagtgctggacctggcgccaccgatatgactaacaacgtcgtgtctactgcccagcaatgtcccaacaccgttttcgtgcttggcggctactctcaaggcgccagtgtcactgacatcgctattggaatacaaacaactctaggctcgggtgtcaatatcccagagacgttggcaccgcgaatcaaggcggtcgtgacgttcggcaacccgttaaagatgatgggtcagaccattgcaagctccagccaaacctacggatccaaagcgattgaattctgtgctacgggtgatccagtgtgtggtggtggtttcaactttatggctcacatgatgtatccgacggacggcagtgtgacgaatgctgctcagcaggccgctgcgatggtgcaaggtggaggtggtgcggtagcagtcaggaccttgcgtggataattgcagtgactgtgttcttggagaaccagtgcacaaaacttcttccttgagtgaaacgtgcatccttattcaatataaacgttgtgccatgttctttccgtcgtcaatgtgtctcgctcaccttcctcaaactctccgacctcgtcctaaactcgaagacgaggtccctgctcgctttctcaatgattataggcccttttataaattataagccatcgcaatctattaatagattggccacggctgcagtcagatggttgcacagcaccagttttcagtactcagctcagtcagctctaatctctagaaatcaacctgcagcataacagtggccactagcctccaggactcgagcctccagcactccagtttgccatcgcctgtaccggtacctacatttcctggaggtttttacttaccgtaatgagtatgtatacctaacggaatcttctttttagtattttactgtagtaatattaaaatactgtacagtatgtatgcacattttaacgtcacgtacatgtaccggtatccccattctatcaaaaatacaatgtaccataaataagactgtgaggtaccggtaaacaaaaggacatccatccctgccgcaatattaataggacgaatgtggacactccctctcatcacttttgacagggtcctacttaaaaatccagtagctcacaaagtgacagtttattttttaggcactcgttatatagcccgactcggagaactgagacgagacatttatgcccatctttgcccgattcatgcccgaacatacccgattgaccaaaagagccggtggcgtcatcatttgattcgtgagtgccgtatacgcggccgagtcctgaatccggataaggaaaaacaacaacacgaaccaaagattcacacattgcagtagcggatccacactgtcgtggtagcccaaaggtgtaccaccgccattaacacttttctgcatgttagagtgatcggtgatgatatcaagatgtaatgagtatggtaaagtaatgcaaaacaaatatattcttgttgagttaattgcaaagtgaaaggtacctataatgcagatattggagctccttccgttttagaaggcttagcggctcagcaccagcaaaatctcgaaggctagtgtggtgtagtgaacacgagattcggtcggagcctcaactaggtcatcctatactagactacaacaaggactgacccaactggcgtgtatacacgcacttaagacgaccaggacgatcgacgatcagaatgttggtagtccagtcggaatgctggtaaccctgtc

SEQ ID NO: 2072 - protein, 223 aa, PHYTOPHTHORA BRASSICAE; identical to SEQ ID NO: 2070

SEQ ID NO: 2073 - DNA, 826 bp, Phytophthora capsici
ggcttactgagatgagatgggaacggaaagccttgggtctacgccgatgcaccacacttgatagcacacgctacatcagctgtctaaatactctccggtttatttcggtgggacatgtacaccgcagttgggatgtcttgagggaggttctttcgagcttgaaggagaatgagagctccgaagacaggacacaatggcactccagtcgttgccgtgtcgtcacggctcgcctacgatccgattaaccgcagacacaccgattgtgcctgattcagagaggctcccactgaaacgagatgagcctggctcacggtcgatgcgcagcaccttcataccatcttcacaatgctcgaacttgtcttcggcaacggcttcgtcatcgcgtcggcgatcatgtcgtcggtaccaacatggcgaagccgttgcctcgtcctccactaggtggcgcaccaagtggaacttgttcataatatgcttgctcttgctgtgcttgccaggcttggcagttagatacatgcacgacatgttttcgccgtgtatctccggagtcgcaaactcccagcatagttcgtcacagagtccacgtagccactgtagatctctggtaccttcattcatagcaatatactctgcttccgttgtgctctgtgcgttgatctcttgctttcttgatccgtacgaaaccacattgccattgacgaacgtgacgaactgcctaacactctttcggtcatcagggtcattgcgtagtgagcatcggtgtagcacgtcagattcacgtcgttcccggcaacaattgtccatcactagccgtggttctgcttga

SEQ ID NO: 2074 - protein, 210 aa, Phytophthora capsici
MALQSLPCRHGSPTIRLTADTPIVPDSERLPLKRDEPGSRSMRSTFIPSSQCSNLSSATASSSRRRSCRRYQHGEAVASSSTRWRTKWNLFIICLLLLCLPGLAVRYMHDMFSPCISGVANSQHSSSQSPRSHCRSLVPSFIAIYSASVVLCALISCFLDPYETTLPLTNVTNCLTLFRSSGSLRSEHRCSTSDSRRSRQQLSITSRGSA

SEQ ID NO: 2075 - DNA, 1177 bp, Monilinia fructicola
ggcacgagtcactctctttcactttaccagcatctacaggttcacactctctttcattctttatacacagattctacattctctctcaccaaactatccatcgaccacctcatcgatcacctcgtcgttcattcccaaaatctcaatacacaaatctcaaaatgaagacctcagctcaacaacttttgtctcttctcctcctccctctctctgccattgcagctcctacaggcgaaattgaagccagagcatgctcaacagtaaccgtcatctttgctcgtggaaccaccgagactccaacacttggcacggtaattgggccccaattcctcgctgccctcaaatcttctttcgggggaagtgtcaccatgaacggtgttccctacgcagccgacgtaccgggattcttgaaaggcggagatcctactggaagcaaggtcatggcaaacatggtttcctcagccctatccagctgcccaaacaccaagctagtcatttccggttactcccaaggaggtcaattggtgcacaatgcggccaaacaacttccagccgctaccaccgctaaaattgccgccgctgtcattttcggtgacccagacaacggatccccagttcaaggtgtcccagccgcaaagaccaagatcatctgtcacgccggagacaacatctgtcaacacggctccatgatcctcatgccccatttaacctacggcatggatgccaccgccgcagccgctttcgtcaagcaagttgcaggctcctaaatcggccgccccttggggtcagaagcgattgtgcggcgcgcatcggaaagaaacggactggacttcctatgatgacacgatatatgattgaaactggaatttctatgtcttccatgcggctgcggtttccgcttgcatttttgtgttttcctttgtttttttgggggttgcctggggcacttcgatactacactcgttccgttcttgaatttctcgttcttcttcctctcttgctggctttctctcttctcccccctctctctctctctccttccttcccacacctcatcatcactttctctttcagaacgtatggattggattggactggattggatcgaagggaaatagttagaaaatagcaggaaatttatatctcgtaccaaaaaaaaaaaaaaaaaaaaaaaaaa

SEQ ID NO: 2076 - protein, 201 aa, Monilinia fructicola; identical to SEQ ID NO: 2058

SEQ ID NO: 2077 - DNA, 1308 bp, Blumeria graminis
ggctccaaccgcaggtccttcatcgtgtccgctaggagatatcggttcgaataccgcaccataatgtccctcacactcttttctttcctttccttggtctctattctctgcatagtcaccgcagcacctgtcactaatgtcaactttacgtctatccaggtcagctctatgcaacatatcgctgctattaataaggcctctttcttcagtcctactgcactacctgcgaatgccactgaaaacggtctcaccggaagctgcaaaccgatcatactcatattcgctaaagggactggtgagaatggaaatgtgggcgatggtagcagtcctggtccggcttggttctctgagctgagaaatgccattggcgaagataagattgctgtgcagggtgtacaatacgaagctgatgtctttgggtacgtttggatgtgggatgggacatgaatattcaaaggctaacaaagaaatagttatcttgtaggcggagaccccgaaggaagtcaaaactaccttactatcacgaatcaagccgtcacacagtgtccaaattcaaaaattgtaattggtggctactctcaaggagctcagattacacacaatgccgcccaattatattcaccccttgtcacatccagaattgccgccggtacggattccccttctattaagatattatctctgctaatatgacttagttgtactcttcggagatccatacactgacaaacctgttggccaggtctcgccaagctctgtattggaaatatgtcacgatggagacataatctgtacaggatctggagggcctgatcctcatctgacatactccaaaaacgccacttgtgctgcaaaatttgtcttggaccgaatttaataaaacatttgaacatatattaacttacatctacggaatcatacggtatacagggaggtgtttaaaactgggtaatagtaaaaatttatgggaattatagccttaattagttggataaaatttattcatttgtataatttccttggtactacggtagattatcaatagaacatggagtactcaactgttgatttactgccgaagagcttgagaaattctctgtaggtaatcttgtggtcatgcaatagatgagcactggtcatttgcactgatagaagtgacgcatgcagtaaggcggtggcccccataagttgccaaaccaggatagaatagaataaaatgacataagtctgtgggttgaaatgtagtttctccggctcacttccccgccatgagtgacccaatccaatgggtgagttaatttagggcta

SEQ ID NO: 2078 - protein, 236 aa, Blumeria graminis
MSLTLFSFLSLVSILCIVTAAPVTNVNFTSIQVSSMQHIAAINKASFFSPTALPANATENGLTGSCKPIILIFAKGTGENGNVGDGSSPGPAWFSELRNAIGEDKIAVQGVQYEADVFGYLVGGDPEGSQNYLTITNQAVTQCPNSKIVIGGYSQGAQITHNAAQLYSPLVTSRIAAVVLFGDPYTDKPVGQVSPSSVLEICHDGDIICTGSGGPDPHLTYSKNATCAAKFVLDRI

SEQ ID NO: 2079 - DNA, 5768 bp, Glomerella cingulata
cttggatccaaatcatgtctttcgagagacataaatgcgcttgggtccaaagatgagatgaatctttcatccacagtcgctcgttcagacaagcccagtcttccctttactgttctaagatgcgttttgctcatgccatcatcgtcgccttgctggcccagaatgtcgtctcttacgacacttctcttggcttcaacacaccccaagtcaatgagaaccgcactatcgacgagatctaccaagcagccctcgcagaaggcggtgtagtcacctgctggcacggcggtgacgaagtgaatcaacaagacggcctgaagcgtgccttcgagacacgctttccgggcatgacactgaacgtcacggtcaaccgctctaaataccacagcgtcaacatcgacaagcagctcgcttcaggccaacctctcgaagtcgacaccatcatcctccaagcgcttcaagactacccccgatgggatgctcagggagcgcttctgcactacgcaccgactaactacatgaaagtcctggcacccttcagacacattcgcgccgcatactacggctttgccatgaacgcgtggtcaaccgtctggaacacgcagaagctagcgaacccgccacgcgagtggcctgactttctgaagccggagtacaaggacaagatcgtcttgacgcacccgagcgatgacgatgcgatcgcatacatcttcgacctcgtgtacgatgcttgactcactcaaagagaaacattgctaacctttttcaggatgaatcggtacggccccgaatggttcgatggcctcttggctaataatccccgttgggttcgcggcactggctcgcctctggccgtcctccgtcagcctaacagcacgcagtccgtgacgttcaccgctagtatcggtctccgggcctcgggaagcctcaacgcatcgtttcccgccgagggactcttcgtcagctggcccaggtccgttgccattttcaaggacgcaccccaccccgagtcttccaagctctttgccaacttcctcttgagtgatgagttccagcgcaactcgtcgcaatggagcgcccgcaaggatattactgcccctggaggctacccgggtattctggatatggacacgaccaactctgccgagtatcttcgcttcatgtcggatcgtggtagagtggaggctcttcggatgatgttcgaggatagaattggtatgccacaaggccccagccctctggtcgatgacctttgagtcaaatgtctctggtggatcatggggtctcagtacgaaattcggcaaagatctctggcccagtcaatagttcggccttgacttggcaacgtcgttgactatcattccggtgatcgtctctttcactagtatagccattatcaattgtctccacactgttctagccccccggtgaaaacgtgcttgtcgcatgatgtcggggtacagatcttttacgcgtacgcatgcgagcccgttggtgagactctcagccaaggaaaagaaattcgcaacttttacacaatgaggactagctcatcgcatgcaactctcatgccccccagacaacccacacttcaaagtggtaagtaccggccgccggcgtagcacacgcgctccacgcatacctgtacatgcagctcaacggtcgggcccagcttggctgacctgctcaactcacaacttcaaccagtaagacgtcgaagatgagctcttgggaacttgttcaagcctgaaacctctgcgagccgttccaaaaacgacttagtcagacgcccgagccgaggcatccaacgtcgccgagttgcggggttctgcggggccgcatatctctaccggccgacttgcagggccaagggtttcccgttgcgctgggttttgttggtttctgggcgactggtaaatggagtaccatccatcatgcctggccctttccttaaccagaagagattgaaggacttccacgattcctgttggctcaaaccacaagagccatcctcacccaacaggaattacccgccggaaacggccataagccgcatcaggcccctcattccagacctatcttccctgatgctatgtcttgtcccgaggctcgcccctttttttcctggctcgctattgccacaattagagggattgcggagcgtcttccgaccatacccaatttgatggaaacttgcgaaatggcgaccctcacgtggcatcgtgggccttggaacgcccagctcaccgactgtggaatcttggtgatgagaattgcttcaagatgcgactggcggaggaataacggagttcatgactctgattgagggaaccttgttgacgagcgattttgaggatcagggtcagctaggttagtcgctgctttcgggcatagatcgaagctcgtgaaggatcaaagtcgtcagggttctcgatgggataaactgacatgtcactttgacatctgttcctcatcgtgaactgactgagcttgcatgagttgtcttgcaagatctcgtacttctcatctgttgatcggcttcacgagatcttgtactcagtacatctcgcggatttacctccgcctgtcatgaagtgtcaactgtaagcacgaaacgatgacaaccgtggaaaccaaacaacataaatagggcctcacgatcctctcaatcacgactttcttttggatcagcagactcaagccctcgctcagactgacagctccgccttctccttcgctccaagccgacgcagcacattctctcagagaccactctcttcagacgacgccccgtccccaaacatctaaaatgaagttcctcagcatcgtgtccctggccatcaccctcgctgcggcggctcccgtcgaagttgagaccggcgtcgccctcgagacccgtcagtcgtccactcgcaacgagctcgagaccggcagcagctccgcctgccccaaggtcatctacatctttgcccgtgcctcgactgagcctggtaacatggtaaggcttccttcggcccatcttcaaaggcccatattgacatctcgaatagggaatcagcgcaggccccatcgtcgccgacgccctagagagaatctacggtgccaacgacgtctgggtccagggcgtaggcggcccctacctcgccgacctggcctccaacttcctgcccgacggcacatcctcggccgccatcaacgaggccaggcgccttttcaccctcgccaacacaaagtgccccaacgcggccatcgtctcgggcggctacagccagggcaccgccgtgatggcgggctccatctccggcctgagcaccacgatcaagaaccagatcaagggcgtcgtgctcttcgggtacaccaagaacctgcagaacctgggccgcatccccaacttcgagacgtccaagaccgaggtctactgcgacattgcggacgcggtctgctacggcaccctgttcatcctgccggcgcactttttgtaccagactgatgcggctgttgcggccccgcgattcctccaggcccgcattggttgagagctttgaagggggatcgaaatagggggtagaagggaatgggcatggcgggatcgaggggatgtgtgattgcggctgtggatcggtcagggggagggttggctgagcttggtgctcaacattctattctgtcactcactttgtcattcgcttttgtcactcgcttagtacatgttgcttcaggatagctgttacgaacgcaatgaaatgcaagttgttttgtattgctaaggggtatcattgattatcatctcctaagtggtatcatgccagtctcttgtcaaagtctgacagcagctcctgatccaatcttcgtctccttccatcatctaccgttttaaaaacttttcccaactctgtccacatagttgcctatgcccttgccttcgcctttttgcgaagatgcgcagcatgcgtttgcatgtgaaacttgacatcaggggggtgcagtgggttgtacaccatccggcataccttgcactcctcaaacgtgggctttgacgagatattgatggttgtctgtatcgtcgcaaccggcttcgactttgcctttggtttggctgtcgcggctttcgacttcggctcgggactctccttccgttcgttcaacttgctttccttcgcctcctgcagttgctttccttctcgtcgacttgatcgcgtgacccgtgtcgccgtctcttcgtctttgctcctgtccagcttgtcggcctccgcatcgtcgccatctggagaaggcagactgtgtcgcaggcgcagtctccttggctctcgtatccttctcacaatcggttgtgatgaagggggcgtgtcgattagcttctccgagtcggacagaggatctgagggatctgagggttccgttgctgagttagagcggcagggcttgaagtagctgaggatggagctcttggggatgttgctcgtgtgtgccgggggcgggggtgggatgcgagggagctctggttgcttcgcgaggacttcttcgatgacgatcttttgtttcttggctggcttcgaggttgattcatcttcggttgctcgcgaccgcttgctatatgttcgcaaggtgcgtctgaacggcgttagttagcaatgcgcggcagagtgcaggaagatttcgtaccgtttctcggtcgtcggacgagaactatcgcgtgatatcgaggagacttcaatctcctcaggctgttccattgttcggatgaaaaccttgagggctctgtcggggcgggtggaagttgagatttggtagaatgcgacgcgacgcgtgtgtgccgtgttattgtagacgagacacgcccgcagatgttgttgaaattttagaagagcatgccgatatgtcgagggtatgagtgcgatcaagaaaaaccgacagtacgccaacacagaagcaataaacagggacaaacgggtatcaaggtcgatgctgtggtggtgtcttgtctttgcctcgcagggcgatggcggatcgatcgagagctttcggggccccaccgaagcgcgtcgcggcaggaatgacgtgcatcgaccgcgtcgagtcgcgttttccacccaccaaggtcacgtgtggcgcctgcattcgcgcccaaacgcttgcgatattagaatatgacatggattgagtttaatgggcaagtgtcaaagtgcagggggtgctaatcggcgagatcttgtgcttttcgtgtggccccgcttgccgggttacaaccggacatgtgaatcggcgccgagtttgttggcccagccggccgggctgctccgtgacacaacgtgaacttggcttgcttttctgacttacattcaacagtcgagacgagtaaccactatcattgtatagtgtggatatgctggttactgccatctggatgatcggtactgatcccaaagacaagtggcacgctgctcagttagaagcttgcggcgcgattggatgaccgccacacgcacgtacatgcgcatcttctcgttgccatagaactcttattaattcgatatgaataaacggctatgtcgagcccttcagtcgttgtcgtataccctcgtccgtatcttgcattttcgtgtcgagcaacaccgtgtccccgtcgcttgtcttttcgtcttggcccacgacccatgtttgcatcacctccctgatttctttgggctccttccgactcgccttggcctctgtcattctccagacatagccagagtacacggcgacctcagcgatcaacaccacaatgcata

SEQ ID NO: 2080 - protein, 224 aa, Glomerella cingulata
MKFLSIVSLAITLAAAAPVEVETGVALETRQSSTRNELETGSSSACPKVIYIFARASTEPGNMGISAGPIVADALERIYGANDVWVQGVGGPYLADLASNFLPDGTSSAAINEARRLFTLANTKCPNAAIVSGGYSQGTAVMAGSISGLSTTIKNQIKGVVLFGYTKNLQNLGRIPNFETSKTEVYCDIADAVCYGTLFILPAHFLYQTDAAVAAPRFLQARIG

SEQ ID NO: 2081 - DNA, 1026 bp, Mycobacterium avium
ccgcggacatgggctggatcgagtcggtgcgcttcggcgagaccatgcgcaaggtggccggggccaccgaggacgtcgccgaaggcatccgggcctggaccgagaaacgcaagccgcaatggcgcggccggtgaggcgtgccggccgggcaccggcaccgccgcgccgggcggtgtgtcaggattccaggatgaatgcacgcagacttgcccgcttggttggtatctcggttgtgacgacgtgggcgctgctgagtgcacccgtgggcaacccggtcgccgccgccgacccctgctcggacgtctcggtggtgttcgcccggggcacccaccaggaacccggcctgggcaacatcggccaggccttcgtcgactcgctcacctcgcagctcggcgggcggtccgtcgacgtctacgcggtcaactacccggccaacgacgactaccacaacagcgcgaacgccggcgccgacgacgcgagcgcgcacgtccaggacaccgtggccgcctgccccaactcgcgcatcgtgctcggcggctactcgcagggctcgaccgtgatcgacctggccaccaacgcgatgccgccctcggtggccgaccacgtcgccgcggtggccctgttcggtgagccctcgagcggcttctccaccatgctgtggggcggccagccgctgccgacgatcaacccgctctacggcggcaagaccatcagcctgtgcgcccccgacgacccgatctgctccggcggcggcaacatcatggcgcacgtgtcctacatcgacgcgggcatgaccgcgcaggccgcgacgttcgcggccaaccacctcaaccagggctcgccgcgcacctagcttccgctcaccgtggctgcggcgttgcccctggtcaagttgttccgcgacaccgtcgcggtgcggatgtcggtggccgtgctgctcggcgtcgccgtcgccgtggtggtgggcaacaccgtcggctggcggttcgcgctggtcggctgggtggtgacggccggggtgtatgt

SEQ ID NO: 2082 - protein, 220 aa, Mycobacterium avium
MNARRLARLVGISVVTTWALLSAPVGNPVAAADPCSDVSVVFARGTHQEPGLGNIGQAFVDSLTSQLGGRSVDVYAVNYPANDDYHNSANAGADDASAHVQDTVAACPNSRIVLGGYSQGSTVIDLATNAMPPSVADHVAAVALFGEPSSGFSTMLWGGQPLPTINPLYGGKTISLCAPDDPICSGGGNIMAHVSYIDAGMTAQAATFAANHLNQGSPRT

SEQ ID NO: 2083 - DNA, 1350 bp, Aspergillus oryzae
gtcgaccatacaagtctcggcagctgggagagaatcatttgtctcactggcattccgagttgcagttgcagttgacctatccaaatcactgattcccgcgcacggtgtctgccaggaaagctaggcactatatgtgtatcaaacaggacaatataccgaggcatacgtgctggatgctgtgagcaatgcaattactataaagatggctgctttgccccaggaagaatgactatacagactgcatcgcactcgaattgcacacacacagcccgctttctaaaacactttcctcattatgcatctccgcaacatagtcattgcactggctgcgactgcagtggcaagcccggtggacctccaggaccgccaatgtatgttagagaaggaacccctccgtcgcacgcatgctaacaatccgatcagtgactggtggggatgagctgcgggatggcccttgcaagcccattacgtttatctttgcccgggcttccacggagccaggccttctggtgagttcaagtcccctatgctttacgtgaaaatactcataaacccagggcatttcaacgggccctgcggtctgcaatcggttgaagttggctagatcaggcgatgttgcctgccagggtgtcggacccagatatacggcggatctcccatcaaatgctctgccagagggaacatcccaagctgccattgcagaggcacaaggactgtttgaacaagctgtttccaagtgccccgatacgcagatcgttgccgggggttacaggttcgtctaggttatccgaaatgttgtttcattcacactaatggtatctctagccaaggaacagctgtcatgaatggggctattaagcgcctttccgcagatgtgcaggacaagatcaaaggcgttgtactgttcgggtacacacgcaacgctcaagagagaggccagattgccaactttcccaaagataaagtcaaggtctattgcgccgtgggagatcttgtctgcctgggaacactgattgtggcaccgccgcacttctcatacctttctgatactggtgatgccagcgatttccttctatcccagctgggataaattttcgggactcatccggtctgctgccttgcgtcggatgctctcctctctctctgtgtctgttcgttttctcacagatgtctctcccatttgatggaggtcagttacccgatggggtactcgtacattcgtccgtcatgaatgcttttcattcaagataaatactttacagagttggaatgttactgaacgtttcgtttaaatctccacaatcctccttgaaacacgagatatccccaattaaaccgtgtattgcgcgg

SEQ ID NO: 2084 - protein, 213 aa, Aspergillus oryzae
MHLRNIVIALAATAVASPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLG

SEQ ID NO: 2085 - DNA, 2769 bp, FUSARIUM SOLANI
agtggaaggggagccgtgtggaggcacaagaagctgaaaaaaccgaggtcaaaagacctgctgaatagtttgtcactgagatgagatgggaacggcatgaaatcttgggccttattctgacaccatcgcctccttcctggtacgccttgcatcaaaagagagggttctaccccctaaaagcacagctcgaatgaaattcccatttgagtagatccaacgatgctccgtgtttctctaggttgggtaggcaggttgacccacccatgatgagcggcagggtcaggtaggtcggtaaatatccgagccgctgatttgcggatgaacgagtccaagcttggcatgatctgttgatctcaaaaccctccaatcaccgtaaagaggcactcgtaaaagtcctccgatgcctctccaccatcaggtaggtggtgtctatgcgcgctctgacactcttcgcaaggtgtaacagaataggcaaagcggccttcccgaggtttcatctctaaaaccaaactcacgcttgtcaaagtgacagctgaacagccgatattcgctgattgggctctttcatgtttgcgggaacgttccatctaccggtttagcgatcggcacgggttgcaactagaagcggaagagcttgcggggaggggcacggggtggtttcctgaagcgactaggttgcctgaaactatcacgactcatagctgcgagcgcatggtccagtatcaagagttttgacgtcctttgatgaaaactgcccctctcttgacgctagaaaccgaggaaatggatcgcgagccgaggctcgatttcagagcttggacgatgatagtttcatctgttcaagcttaaatatcgttgttccagaccactgggaacggaaccagacaaccacacataccttcacttcatcaacattcacttcaactcttcgcctcttccttttcactctttatcatcctcaccatgaaattcttcgctctcaccacacttctcgccgccacggcttcggctctgcctacttctaaccctgcccaggagcttgaggcgcgccagcttggtagaacaactcgcgacgatctgatcaacggcaatagcgcttcctgcgccgatgtcatcttcatttatgcccgaggttcaacagagacgggcaacttggttcgtagaatttcttctcatgacaacatcacttttcttacacatccattagggaactctcggtcctagcattgcctccaaccttgagtccgccttcggcaaggacggtgtctggattcagggcgttggcggtgcctacgcagccactcttggagacaatgctctccctcgcggaacctctagcgccgcaatcagggagatgctcggtctcttccagcaggccaacaccaagtgccctgacgcgactttgatcgccggtggctacagccagggtgctgcacttgcagccgcctccatcgaggacctcgactcggccattcgtgacaagatcgccggaactgttctgttcggctacaccaagaacctacagaaccgtggccgaatccccaactaccctgccgacaggaccaaggtcttctgcaatacaggggatctcgtttgtactggtagcttgatcgttgctgcacctcacttggcttatggtcctgatgctcgtggccctgcccctgagttcctcatcgagaaggttcgggctgtccgtggttctgcttgaggaggatgagaattttagcaggcgggcctgttaattattgcgaggtttcaagtttttcttttggtgaatagccatgatagattggttcaacactcaatgtactacaatggcccatagtttcaaattaaagaagcaatgaatggtgatctacatatcgctttgcccaagaaatcccaaccaggcttccataccctgagccagttgagcacaaatttcgtgccctctgctgagcttgccaggaaaggtcgatacataaaccggccttgacagacagggcgctacctgcacgaattggtcccgccaggtgtgcgctcaaggcgaagttcgccgatttatagaccacctctcattcccatcatgcacatctgtccctgactcgccttctccatcaataacaccgagattggttacaatccaggatagctcgcgatccctctttgcttgatctccgtgatactcctgccaatcatgcactagcttcatcaagccaacaatgttgtttttcaggccggcgttcaacctttcctcgatatccccacgggagaccttgatgcggaccatatctccctctcaagatcacggacaggttggttttcccagttgttggcccgggctgtggctcgaatatccgcaactaggtcggagtcaaacgtatggtggatagtcgacacgcagttctgcaccttccgttgggtctcagctgcattgcctttttcggggtacatgaatctccgctggtccattgcagtagaggcggtgaaagcgcgggccttcttttcagggacgtagcaagcctaaacatgctagcctgatgccgtgaagaagaccagttagagtggtaccatgctgacgacaggcaccaagaatgcgacaaagagctgcatttggatgctaaaagaagttgtctgggaagcatatgacccgagttgaagaggagcccacgtggcctttgccgacttggaggagagtaacgatggaccgaaggtatgccatacttgtgaaaaagcaaacccgagagttatggggtgtttggccaacttctcctgaggaagagggagatc

SEQ ID NO: 2086 - protein, 230 aa, FUSARIUM SOLANI
MKFFALTTLLAATASALPTSNPAQELEARQLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSA

SEQ ID NO: 2087 - DNA, 883 bp, FUSARIUM SOLANI
aaccacacataccttcacttcatcaacattcacttcaacttcttcgcctcttccttttcactctttatcatcctcaccatgaaattcttcgctctcaccacacttctcgccgccacggcttcggctctgcctacttctaaccctgcccaggagcttgaggcgcgccagcttggtagaacaactcgcgacgatctgatcaacggcaatagcgcttcctgccgcgatgtcatcttcatttatgcccgaggttcaacagagacgggcaacttgggaactctcggtcctagcattgcctccaaccttgagtccgccttcggcaaggacggtgtctggattcagggcgttggcggtgcctaccgagccactcttggagacaatgctctccctcgcggaacctctagcgccgcaatcagggagatgctcggtctcttccagcaggccaacaccaagtgccctgacgcgactttgatcgccggtggctacagccagggtgctgcacttgcagccgcctccatcgaggacctcgactcggccattcgtgacaagatcgccggaactgttctgttcggctacaccaagaacctacagaaccgtggccgaatccccaactaccctgccgacaggaccaaggtcttctgcaatacaggggatctcgtttgtactggtagcttgatcgttgctgcacctcacttggcttatggtcctgatgctcgtggccctgcccctgagttcctcatcgagaaggttcgggctgtccgtggttctgcttgaggaggatgagaattttagcaggcgggcctgttaattattgcgaggtttcaagtttttcttttggtgaatagccatgatagattggttcaacactcaatgtactacaatgcct

SEQ ID NO: 2088 - protein, 230 aa, FUSARIUM SOLANI
MKFFALTTLLAATASALPTSNPAQELEARQLGRTTRDDLINGNSASCRDVIFIYARGSTETGNLGTLGPSIASNLESAFGKDGVWIQGVGGAYRATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSA

SEQ ID NO: 2089 - DNA, 2557 bp, Colletotrichum capsici
ctgcagccgaggcattcaacgtcgccgagttgcggggtcctgcggggattgcagttctctaccggctgccttgcataaactagactgttgtgcgttgtattatgttgcaacgtaaaccaaggaccctgttaatcccttacaactttcctctgacagagtaaaccagaaagacatcgcgaaactgctagtggttgaccatatcactcgatcaccgtcgaatcgagaaagtcataggccgcattttcccctcactccaaagtcatgcttcttccctggcgtcagacggtggaccgaggctggccccttttcctcagccaaagagatggaagagtttcttccgaccattcccaatttgatgttctgtcgcgaaaagccgatcctcatgtgatctcgcagccttggaacatctaccttgcggactgtgggatctaggtagtcggggatggcttcaagatgcgctggcggaggaatattgtatgtgtttctctggttgttgagatccggttagtacgcggcttgaatagttcaggagtggacagctagtgagacatcatggaatggattgtaagccggataacgaggcaatcatggccatagacgctccatggcatgaagataaatagctcctgaacaacccacgaaaagactcttgatatccagaccatcatcagattcaatctctcactcagaccccaaacactctctccttcgctcgaagctcagccagcgcgctcactccaaagatcattctcttctcccgcaagtcgtcgcatctgaagaccagtcccaatacacaaaatgaagttcctcagcatcatctctcttgccgtttcccttgtcgctgccgctcctgtcgaagtcggcttggacaccggtgttgccaaccttgaggcccgccagtcctcgacccgcaacgagcttgagtctggcagcagctccaactgccccaaggtcatctacatctttgctcgcgcctctactgagcccggtaacatggtaagtgacagtcaagcgtcctcccttccacaggatgataactgactcctataacagggcatcagcgcaggccccattgtcgccgacgctctcgaaagccgctacggcgcctcacaggtctgggtccagggcgttggcggcccttactctgccgacctggcctccaacttcatcatacccgagggcacctcccgcgtcgccatcaacgaggctaagcgactcttcacgctcgcaaacaccaagtgccccaactccgccgtcgtcgcaggcggatacagccagggcacagccgtgatggcctcctccatctccgagttgagctccacgatccagaaccagatcaagggcgtcgttctgtcggctataaccaagaacctgcagaaccttggacgcatcccgaacttctcgacatccaagaccgaggtgtactgtgccctcgccgatgctgtgtgctacggcacgctgttcatcctgccggcgcatttcttgtaccaagccgatgctgctacttctgccccgagattccttgctgctcgcattggctgagctccacgcgagggaaatatttccacggacctaggctgaggggagaacgggtctgaacagggctcgaaggacgggcgtccgtggaaaagatactgagtatctggttgtggctgttgatcggtcagctttggggaggaggtcgaagtggatgcggtttttcgtttcttatgcttatgctggctttaacactctttttttggtcactctttcatgctgtatggtttttgagtattgtagcgagggaagtaaaacgaaatgcaacgtgtttgtattgctaagggttatcattgactcattacctctcaagtggtatcatgataatgtctcacacggcgctctccgacaaaatctgactgcatctctcaggctctctgtctgccccgcaagtacgccgcatgcctctgagaatggtacttgacatcagggggatgcagcgggttgtacactatacgacatgtcttgcattcctcaaatgtaggcttttgatgagatgttgatagttgtctgtatcgtggcggttgatttagatcgcaagttcggtttgctcgtctgctggttcggcttcgcttttacgcccttcctcctttcgttaagcttgctctccgtcgtttccagtaattgttttgtgacccgtttacttgaacgagtgatctcctcgtggccagttcaccatttacccacttatcgtccgcttcttcttcggtctcatttattgtatctgatgacggaatagtcgctgagctatgtcgtaacctaagcctgcgaggctctcttatccttctgataacgggcggcgacgacggcggagtattgacgagcttttccgagtcggagaggggatcggacgcttctgttgccgagctagagcggcagggcttgaagtaactcagaatagagctcttgggaatattgctcgccttagcagaaggccgtggtagaccggattgtgcgacaggtgtccgtcaatcaggtatcttttgccttttcagcggcttagcgttcgcatcatcctcgg

SEQ ID NO: 2090 - protein, 228 aa, Colletotrichum capsici
MKFLSIISLAVSLVAAAPVEVGLDTGVANLEARQSSTRNELESGSSSNCPKVIYIFARASTEPGNMGISAGPIVADALESRYGASQVWVQGVGGPYSADLASNFIIPEGTSRVAINEAKRLFTLANTKCPNSAVVAGGYSQGTAVMASSISELSSTIQNQIKGVVLSAITKNLQNLGRIPNFSTSKTEVYCALADAVCYGTLFILPAHFLYQADAATSAPRFLAARIG

SEQ ID NO: 2091 - DNA, 1545 bp, Alternaria brassicicola
tcctccccgtaccacacgacctgtccagcccaccatcagcgcttcatccatgtctgcttaatatgcatgcctagacacagatcccaggcacagagtactggaccgaggaagctcagatgcaatcaagatgcctactggtcaactcgtcgacggtcaacagcaaacaccagatctcgatcttcgaaagatcgtatgagaacggccgcagtactctttgggggcagcatgtccgctcaccaatatcaagatgcattccaagatcccaggcaatccggataccgaggtagttgctgaaaatatgagtgtgaagacagcatcttctacatgtaaagaagagcataaaaggaaggggatgcgtcacgattagagacacagcacagtcaagcagccgacttccaaccttttcagaccactctaccctccagagctatcaggcacagtctatcgttcacccaatcgccaacatgaagtccattgcaatcctttctcttttcgctgctctcgctcttacttcgcccatcgccgtcgcggtacccgtcactgcgcccaatgatgaacctcaacttgttactctcgaagccctgtcaggctagtactaccagaaacgagcttgaaacgggaagcagcgatgcttgcccacgcaccatcttcatcttcgcaaggggaagcactgaagctggaaacatggtgagtacaagcaaattctctacagactcctccataacagcaattaaccatcacagggcgcactcgtcggtcccttcacagcaaacgccctcgagagcgcgtatggggcatccaatgtttgggtccagggcgtaggtggcccctataccgccggtctcgtagagaatgcccttccagccggtacttctcaagccgccatccgcgaagcccagcgcctcttcaatctcgccgcaagcaaatgccccaatacccccatcactgccggtggttactctcaaggtgctgcagtcatgtccaacgcgatccccggtctcagcgctgccgtacaagaccaaatcaagggtgtcgtgttgttcggctacactaagaacttgcaaaatggagggaggattccaaacttccctaccagcaagacgacgatctactgtgaaaccggggacttggtttgcaacggtacactgatcatcacgcctgcgcatctcctgtactcggatgaagctgctgtgcaggcacctaccttcttgagggctcagattgactcagcatagtcggctgtgagagatgtttggaagggcactgtgcaacatgcatggataaaactttgtatgccactatttgggttgttggcacgagcagatgcttgacattcttgttggatggaggacgcattctttacagtagtcgctagtttttttcattgagccaatcgtaaacagactcagtccatcgttcgcgcgacaatgtcccaaactcataactcacttgacctagtagctactcgatactaaactattagcccattcctctacgtccttgaactgatcctcaacatcatcaggtatgccgttgccattcgca

SEQ ID NO: 2092 - protein, 209 aa, Alternaria brassicicola
MMNLNLLLSKPCQASTTRNELETGSSDACPRTIFIFARGSTEAGNMGALVGPFTANALESAYGASNVWVQGVGGPYTAGLVENALPAGTSQAAIREAQRLFNLAASKCPNTPITAGGYSQGAAVMSNAIPGLSAAVQDQIKGVVLFGYTKNLQNGGRIPNFPTSKTTIYCETGDLVCNGTLIITPAHLLYSDEAAVQAPTFLRAQIDSA

SEQ ID NO: 2093 - DNA, 286 bp, COLLETOTRICHUM GLOEOSPORIOIDES
accgcgaacgtccgcatcggtagcaacaagtctgtcattggcctccctggagctggtaagccatatcaagagctattgttaaacatagttgctgacgagttcaggttttgatggcatcgggctgcacgctcgtcgtcagagcaacatcattgtgcgcaacatcaagtcaaccaacatccttgcctcgactggcgacggtctcaagattgaggtgagccaattgagcctgtgttgatggtaacacacggactaattcctggtcaacacatagcaaagcacaaacgtc

SEQ ID NO: 2094 - protein, 59 aa, COLLETOTRICHUM GLOEOSPORIOIDES
TANVRIGSNKSVIGLPGAGFDGIGLHARRQSNIIVRNIKSTNILASTGDGLKIEQSTNV

SEQ ID NO: 2095 - DNA, 2603 bp, COLLETOTRICHUM GLOEOSPORIOIDES
tggtttttgctttgcgccctcggccgattacagattttgaggcctcgaagggtagcgcctagacagcttgtcagtaagatgaggttgtctgtcgtctcgtccctgttggtgggggttgtgcagggcagctcagggggcggagaggaacggcggaaggaaagacgagacgagactaagatggagcagagaaacagacggagggacgatgaaccaacagaatgtatatatcgtcgacatcagccggctgttcttgacttgggaagatcctttcttcagcagctttcgctcttcaacattctctctttattcgactaccgactccacattcattcattcttttgtacctactacttctgttcgttccgaaagcttagcaccatgagatctgcatctatcctctccgcggcactggctgcctttgctcccctggcctcggccgcggacgccgtttctggcgccgctgaaggctttgccaagggcgtcactggcggtggcagcgccactcccgtctacccttccaccactgccgagcttgcctcctacctcaaggactcttccgctcgcgtcattgtcctgaccaagacctttgacttcaccggtaccgagggaactaccaccgagaccggctgcgcaccttacggcactgctgctgcctgccaggtcgctatcaacaaggacaactggttcgtaaacaatttgaaacattgtttcttgcattgtcactgatatcgaggttgtcaggtgcaccaactaccagcccaacgcccccaaggtctctgtcagctacgacaaggtaggaaatcgaacaggaattgtttctaagcttctctaacacagccaggccccgttcaaccccctcattgtcggcagcaacaagtctctgatcggccaaggatctaagggtgtcattaagggcaagggtcttcgcatcaccaactcggcgaagaacgttattatccagaacgtatgttgagtctttgactaggactcagttctcggaactctcagctaatgaaactagatccacatcacgaacctgaaccccaagtacgtctggggaggtgatgccatctctctggacggcaccgaccttgtctggttcgaccacgttaagacctccttgatcggtcgtcagcacattgtcctcggaaacggtgcttccaaccgtgtcaccatctccaacaacgagattgacggctctacctcctggtctgccacctgcgataaccaccactactggggtgtctacctgaccggcagcaacgacatggtcaccttcagcagtaagacatgctttgccgcaatacctcccagcctaagttgccccaagcgtaacgccattacttccagagaactacatccaccacacctccggccgttcccccaagatcgctggcaactcgtacgtccaactttgatatcccgatttgacacagcgtcatcatcgtgcccgaagatgtctaaactaacgttttttgccccgaacagtctcgttcacatctcaggcaattatttctatgctaacagcggtacgtatctttctatattgcaagcttttaaagtatttcatgatgttgtgactcgttctacaacttctatgcttggttttctgcacctccgggcttcgggacggacccgactcggcgaagtgggtcagagagtgcacgggccacccggcctagccatgtaccaccagacgggcaggcatagtgcctcttcccattttgtgtcattcagaagacagacttcagatggctaacatttttctttacaggtcacgccatggaggccgatgctggtgccaaggttgtcctcgagggcaacgtcttccagaacgtagttgctgccatgcagtctggtctggccggcaaggtcttctccagccccgatgccaacaccaacgctcagtgctccagctacctcggccacacctgccagctcaacgcttacggcagctctggctctctctccggctccgacaccagcattctctccagcttctctggcaagaacgttgctgccactgtcaccgccaacgacgccaagaacgtccccaacaccgctggctttggaaagatctaagctttgggtgacgggattgtctctggccgggatgaggctctggaggagtcgcctggtttcagttgaagtggttgagaggaagcaagggggttgagtcaaggcacactagtgaccaacgacagattcatgtacatatcttactttttaccgtcgaggacgtaaatactatgcttgatgcatcaattctgctatatatactgtcccctattgcggaattgacgagttgctcttgaaacaacatcagtaggaatcaagccgagaccttgccgtttttgatgtgtctgcacagcttcaattatctgtgtttgccaacgacttcgatccaggggacgacaagaaccagaggattacaaccagtaagagaccaatatttgcggtaaataacgggaaggcgataatttgcaaactcaataatccgccttgaataggcattaacccctctgtgtgaagagcacctcaattcacatagattacccaacggttcaacatggaatgaccttcaaacacacaggatcaagctt

SEQ ID NO: 2096 - protein, 380 aa, COLLETOTRICHUM GLOEOSPORIOIDES
MRSASILSAALAAFAPLASAADAVSGAAEGFAKGVTGGGSATPVYPSTTAELASYLKDSSARVIVLTKTFDFTGTEGTTTETGCAPYGTAAACQVAINKDNWCTNYQPNAPKVSVSYDKAPFNPLIVGSNKSLIGQGSKGVIKGKGLRITNSAKNVIIQNIHITNLNPKYVWGGDAISLDGTDLVWFDHVKTSLIGRQHIVLGNGASNRVTISNNEIDGSTSWSATCDNHHYWGVYLTGSNDMVTFSKNYIHHTSGRSPKIAGNSLVHISGNYFYANSGHAMEADAGAKVVLEGNVFQNVVAAMQSGLAGKVFSSPDANTNAQCSSYLGHTCQLNAYGSSGSLSGSDTSILSSFSGKNVAATVTANDAKNVPNTAGFGKI

SEQ ID NO: 2097 - DNA, 1380 bp, Bacillus subtilis
ctgcagtcaaaggtgcatcaatcctttcttctgttttaattgttagtgtgacttttagcgcaatctgtatttttaaaataacacggcattaattaggaagatagaacctatcattcctttccatttgctgtaataataatcttcacgaggaaatgattaaaattgaaaggaagcatatgatatgaaacgattttgtttatggttcgccgtgttcagtttgttattggttctcttgcctggtaaagcgtttggagccgtcgattttccaaatacctcaacaaatggccttttaggatttgccggaaatgctaaaaatgaaaaaggcatttctaaagcgagtacaacgggtggaaaaaacggccagattgtttacattcaaagcgtaaatgatttaaaaacccatctaggaggatcaactccgaaaattttagtgcttcaaaatgatatttccgcatcttcgaaaacaacagttaccattggctcaaataaaacactcgtaggctcttacgcgaaaaaaacgttaaaaaatatttatttaaccacttcatctgcctctgggaacgtcatttttcaaaatctgacttttgaacacagtccgcagattaacggaaataatgatatccagctttatttagattccggcatcaactactggattgaccacgtcacattctccggccacagctatagtgcaagcggtagtgatttggacaaactcctgtatgtcggaaaatcagcagattatatcaccatcagcaactcaaaattcgcgaatcataaatacggtttgattttaggatacccagatgattcacagcatcaatatgacggctatccccacatgacaatcgccaacaattattttgagaacttgtatgtaagaggcccgggtctcatgagatacggatattttcatgttaaaaacaattacagcaacaactttaaccaagcgattacgattgccacaaaagcaaaaatatattctgaatataattactttggaaaaggcagtgaaaaaggcggaatccttgatgacaagggtactggttatttcaaggatacaggcagctatccttctctaaataagcaaacctctccgctaacttcctggaatcccggatctaattacagctaccgtgtccaaacgccgcagtatacaaaagattttgtcacgaaatatgcgggatcacaaagtacaactctggtatttggctactgacacaaaagaggcttgcgtaaaaaacgccaagcctcttttgtacttataggctattttaagcgatcttgttacactccatcaaatctaggattggtcaaactattcttaccaaaagcgtattttctttttcacaataacttcttaatcggctttcttattat

SEQ ID NO: 2098 - protein, 345 aa, Bacillus subtilis
MKRFCLWFAVFSLLLVLLPGKAFGAVDFPNTSTNGLLGFAGNAKNEKGISKASTTGGKNGQIVYIQSVNDLKTHLGGSTPKILVLQNDISASSKTTVTIGSNKTLVGSYAKKTLKNIYLTTSSASGNVIFQNLTFEHSPQINGNNDIQLYLDSGINYWIDHVTFSGHSYSASGSDLDKLLYVGKSADYITISNSKFANHKYGLILGYPDDSQHQYDGYPHMTIANNYFENLYVRGPGLMRYGYFHVKNNYSNNFNQAITIATKAKIYSEYNYFGKGSEKGGILDDKGTGYFKDTGSYPSLNKQTSPLTSWNPGSNYSYRVQTPQYTKDFVTKYAGSQSTTLVFGY

SEQ ID NO: 2099 - DNA, 1128 bp, Aspergillus fumigatus
atgaagtacgctgcttttcttcccaccatcggtgcgctggtctcccaggccattgcgattggcgtccaaggcaccgccgagggttttgcctcgtccgtgactggcggtggcagcgctaccctcgtctatccttccaccaccgacgagctggtctcgtaccttggtgatagcgaggcccgtgtgattgtgctcaccaagacctttgacttcactggaaccgagggtaccaccaccgcgactggctgcgcgccttggggtactgcctctggctgccaggtagccatcaacaaggataactggtgcatcaactaccagtcgagtgctccctctgtctcggtgacctatgataatgccggctcgcttggtatcaccgtcaactccaacaagtccctcatcggcgagggcacctccggcgtcatcaagggcaagggccttcgtatcgtcagcggtgctaagaacatcatcattcagaacatcgccatcaccgacatcaaccccaagtacgtctggggaggcgacgccatcaccatcaaccaggccgacctcgtctgggtcgaccatgtaactaccgcccgcatcggccgccaacactacgtcctcggcaccgaagccagcaaccgcatcaccctctccaacaactacatcgacggcgaatccgactactcggccacctgcgacaaccaccactactggaacatctacctggacggctccagcgacaaggtcaccctgaagggcaactacctgtacaagaccagcggccgcgcgcccaaggtccagggcaacacctacctgcacgccgtcaacaactactggaacgacaactccaaccacgccttcgagatcggcgacggcgcctacgtgctcgccgaggggaacctcttctccgacgtgactgccgccgtcgagtcctctagcttcacgggtgagctgttcggctccgcgagtgcttcctcgacctgccagtcgtatattggccgtgactgtgtggccaattcgttctccagctctgggacgctctctgggtcgaatgttgatgtgctgtccaagtttaagggcgagactgttgcctcggcgagtgcggctggtacttctcctgcttcctcggctggtcaggggcacctgtaa

SEQ ID NO: 2100 - protein, 375 aa, Aspergillus fumigatus
MKYAAFLPTIGALVSQAIAIGVQGTAEGFASSVTGGGSATLVYPSTTDELVSYLGDSEARVIVLTKTFDFTGTEGTTTATGCAPWGTASGCQVAINKDNWCINYQSSAPSVSVTYDNAGSLGITVNSNKSLIGEGTSGVIKGKGLRIVSGAKNIIIQNIAITDINPKYVWGGDAITINQADLVWVDHVTTARIGRQHYVLGTEASNRITLSNNYIDGESDYSATCDNHHYWNIYLDGSSDKVTLKGNYLYKTSGRAPKVQGNTYLHAVNNYWNDNSNHAFEIGDGAYVLAEGNLFSDVTAAVESSSFTGELFGSASASSTCQSYIGRDCVANSFSSSGTLSGSNVDVLSKFKGETVASASAAGTSPASSAGQGHL

SEQ ID NO: 2101 - DNA, 1161 bp, Aspergillus fumigatus
atgaagacggcggttctttctcttttcctggccctccagacctatgcccgggtgaccggctctccatctggctttgctgccggcactacggggggtggttcggcgaccccggcagcgccctccagtctggacgagctggtgcaatggatcaccgacgataagccccgcgtgatcctcatcgaccggacctgggacttcatcggcaccgagggcaccaccacgggcaaatgctgcagcatgccctccacgacggtctgcagcggcggaacctccaagggtcaggcctggattcaggatcactgtgatggaggatcctgggtgtcgtgcaagtacgacaatgccgcgctgacgcccctggacgtgggctcgaacaagagcatcgtgggtgtcggcaacaagggtgtcatcaagggcaagggtctgcgagtgcgcaacggcaacaagaacgtgattatccagaatattcacattacgaatctgaaccctcaatacgtctggggcggtgatgccatcaccctcgacaacgcggacaaggtctggatcgaccacaacaagatctccctcatcggccgccaattcatcgtcagcggctggggcaaagcgggccacgtcaccatctccaacaacgaattcgacggccgcacctcctggtccgccggctgcaatggcaagcactactggactctactcctcctcggcgagcaggactactacaccttccaaggcaactggctgcacgacgtgtccggccgcgccccgcacatgggaaccgaccacaccaagtcgcagatcttcttccacggcgtgaacaactacttccagaatgtcggcggacatgcctttgacgtcgacaccaacacctgggtgctgctcgagggcaactactttgagaacgtcaacacgccgctgaccgataccagcctgcgggccggcggcaagctgtacaccacctccacagtggctgcggccggcgcctgtcaggataagctgggatatatctgcgagtggaaccgcttggcgggatccggtgcctggaaggaccgcaccgatgcggatgtcaagaccaaggcggctgcgttcaagagcagcctggtgggccattatcctgtggcggatgtgcctgccaaggttgttgccaacgcgggtgttggcaagctgtag

SEQ ID NO: 2102 - protein, 386 aa, Aspergillus fumigatus
MKTAVLSLFLALQTYARVTGSPSGFAAGTTGGGSATPAAPSSLDELVQWITDDKPRVILIDRTWDFIGTEGTTTGKCCSMPSTTVCSGGTSKGQAWIQDHCDGGSWVSCKYDNAALTPLDVGSNKSIVGVGNKGVIKGKGLRVRNGNKNVIIQNIHITNLNPQYVWGGDAITLDNADKVWIDHNKISLIGRQFIVSGWGKAGHVTISNNEFDGRTSWSAGCNGKHYWTLLLLGEQDYYTFQGNWLHDVSGRAPHMGTDHTKSQIFFHGVNNYFQNVGGHAFDVDTNTWVLLEGNYFENVNTPLTDTSLRAGGKLYTTSTVAAAGACQDKLGYICEWNRLAGSGAWKDRTDADVKTKAAAFKSSLVGHYPVADVPAKVVANAGVGKL

SEQ ID NO: 2103 - DNA, 1122 bp, Aspergillus niger
atgaagtacgctgctgctctcacggctgttgccgccctcgctgcccgcgccgctgctgtcggtgtctccggcactcccgtgggtttcgcctcctccgccactggtggtggtgatgctacccccgtctaccctaccaccaccgatgagctggtctcttacctcggtgatgacgaggcccgtgtcattgtcctgtccaagactttcgacttcactgacactgagggcactaccacgaccaccggttgcgctccctggggtactgcctccggctgccagctggccatcaacaaggacgactggtgcaccaactacgagcccgatgctcccaccaccaccgtcacctacaacactgctggtgaactcggtatcaccgtcaactccaacaagtccttgatcggtgagggtaccagcggtgtcatcaagggccgtggtctccgcatggtcagcggtgtctccaacatcatcatccagaacattgctgtcaccgacatcaaccccgagtacgtctggggtggtgacgccatcaccctcgacgaggctgacttggtctggattgaccacgttaccactgcccgcattggtcgccagcactacgtcctcggtaccgacgccgacagccgtgtctccatcaccaacaactacatcaacggcgagtctgactactctgctacttgcgacggccaccactactggaacgtgtaccttgacggctctagcgacaaggtcaccttcagtggcaactacctgtacaagacctccggccgtgcccccaaggtccaggacaacacctacctccacatctacaacaactactgggagaacaactcgggccacgctttcgagatcggctccggtggctacgtcctcgccgagggtaactacttctccaacgtcgacaccgtcctcgagaccgacaccttcgagggtgctctcttctcctctgacagcgcctcctccacctgcgagtcctacattggccgttcctgcgttgccaacgtcaacggcggtgacctcaccggcacctccaccaccgtcctctccaacctcagcggcgacaccctcccctctgctgatgctgccagcaccagccccgcctccaacgctggtcagggtaacctgtaa

SEQ ID NO: 2104 - protein, 373 aa, Aspergillus niger
MKYAAALTAVAALAARAAAVGVSGTPVGFASSATGGGDATPVYPTTTDELVSYLGDDEARVIVLSKTFDFTDTEGTTTTTGCAPWGTASGCQLAINKDDWCTNYEPDAPTTTVTYNTAGELGITVNSNKSLIGEGTSGVIKGRGLRMVSGVSNIIIQNIAVTDINPEYVWGGDAITLDEADLVWIDHVTTARIGRQHYVLGTDADSRVSITNNYINGESDYSATCDGHHYWNVYLDGSSDKVTFSGNYLYKTSGRAPKVQDNTYLHIYNNYWENNSGHAFEIGSGGYVLAEGNYFSNVDTVLETDTFEGALFSSDSASSTCESYIGRSCVANVNGGDLTGTSTTVLSNLSGDTLPSADAASTSPASNAGQGNL

SEQ ID NO: 2105 - DNA, 1140 bp, Aspergillus niger
atgaagtactctactatcttcagcgctgctgccgctgttttcgctggttccgccgctgcagtcggcgtgtccggctctgctgagggtttcgccgagggcgtcaccggtggcggtgatgccacccccgtctaccccgacactatcgatgagctggtctcttaccttggagacgatgaggcccgcgtcattgtcctgaccaagaccttcgacttcaccgacagcgaaggtaccaccactggcactggttgcgctccctggggtaccgcttccgcctgccaggttgctattgaccaggacgactggtgcgagaactacgagcccgatgctccctctatcagcgttgaatactacaacgctggtgtcctcggtatcaccgtcacctccaacaagtccctcatcggtgagggctcctctggtgcaatcaagggcaagggtctccgtattgtcagcggtgctgagaacatcatcatccagaacatcgcggttaccgacatcaaccccaagtacgtctggggtggtgatgctattactcttgatgactgcgacctggtctggatcgaccatgttactaccgcccgcatcggtcgccagcactacgtccttggaaccagcgccgacaaccgcgtctctctcaccaacaactacattgacggtgtctccgactactccgccacctgcgatggctaccactactggggcatctacctcgatggtgacgccgacttggtcaccatgaagggcaactacatctaccacacctccggccgtagccccaaggtccaggacaacactctcctccactgtgtcaacaactacttctacgacatctccggccacgcttttgagatcggtgagggtggctacgtcctggctgagggcaacgttttccagaacgtcgacaccgtccttgagacctacgagggcgcggccttcaccgtcccctccaccaccgccggtgaagtctgctccacctaccttggccgtgactgtgtcatcaacggcttcggctcctccggcactttctccgaggacagcacctctttcctctccgacttcgagggcaagaacattgcctctgcttccgcttacacctctgttgcctctagcgttgttgctaacgccggtcagggcaacctgtaa

SEQ ID NO: 2106 - protein, 379 aa, Aspergillus niger
MKYSTIFSAAAAVFAGSAAAVGVSGSAEGFAEGVTGGGDATPVYPDTIDELVSYLGDDEARVIVLTKTFDFTDSEGTTTGTGCAPWGTASACQVAIDQDDWCENYEPDAPSISVEYYNAGVLGITVTSNKSLIGEGSSGAIKGKGLRIVSGAENIIIQNIAVTDINPKYVWGGDAITLDDCDLVWIDHVTTARIGRQHYVLGTSADNRVSLTNNYIDGVSDYSATCDGYHYWGIYLDGDADLVTMKGNYIYHTSGRSPKVQDNTLLHCVNNYFYDISGHAFEIGEGGYVLAEGNVFQNVDTVLETYEGAAFTVPSTTAGEVCSTYLGRDCVINGFGSSGTFSEDSTSFLSDFEGKNIASASAYTSVASSVVANAGQGNL

SEQ ID NO: 2107 - DNA, 1140 bp, Aspergillus niger
atgcactacaagctgcttttcgctgctgccgcagcatccttggccagcgctgtcagtgccgccggcgttgttggcgccgccgagggtttcgcccacggtgtcactggtggtggcagcgcttcccccgtctatcccacgactactgatgagctggtctcttacctcggtgataacgaacctcgggtgatcatcctggacagaaccttcgactttaccggcaccgagggtaccgagactaccaccggatgtgccccctggggaactgcttcccaatgccaggtggcgatcaacctgcacagctggtgtgacaactaccaggccagcgcccccaaggtatccgtgacttatgacaaggcgggtatcctccccatcacggtcaactccaacaagagtattgttggtcagggcaccaagggtgtcatcaagggcaagggtctccgtgtggtcagcggtgccaagaacgtcatcatccagaacattgccgtcaccgacatcaaccccaagtatgtctggggtggtgatgccattactgtcgatgactctgatctggtctggatcgaccatgtgacaactgctcgcattggtcgccagcacatcgtcctgggcaccagcgccgacaaccgcgtcaccatctcctattccctcatcgatggtcgctccgactactctgccacctgcaacggccaccactactggggcgtgtacctggacggcagcaacgacatggtaaccctcaagggcaactatttctacaacctcagtggccgcatgcccaaggttcagggtaacactctgctgcacgccgtgaacaacctcttccacaactttgacggccacgccttcgagatcggcactggtggctacgtcctggccgagggtaacgtcttccaggacgttaacactgtggtggagacgcccatcagcggccagctcttcagctcccccgatgccaacaccaaccagcagtgcgcctccgtcttcggtcgttcctgccagctcaacgccttcggcaactccggctcgatgtccggatcggacaccagcatcatcagcaagttcgctggcaagaccattgctgcggctcaccccccgggtaacattgcccagtggaccatgaagaacgctggccagggcaaataa

SEQ ID NO: 2108 - protein, 379 aa, Aspergillus niger
MHYKLLFAAAAASLASAVSAAGVVGAAEGFAHGVTGGGSASPVYPTTTDELVSYLGDNEPRVIILDRTFDFTGTEGTETTTGCAPWGTASQCQVAINLHSWCDNYQASAPKVSVTYDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGHHYWGVYLDGSNDMVTLKGNYFYNLSGRMPKVQGNTLLHAVNNLFHNFDGHAFEIGTGGYVLAEGNVFQDVNTVVETPISGQLFSSPDANTNQQCASVFGRSCQLNAFGNSGSMSGSDTSIISKFAGKTIAAAHPPGNIAQWTMKNAGQGK

SEQ ID NO: 2109 - DNA, 1086 bp, Aspergillus oryzae
gccggcgtttctggttctgctgagggtttcgccaagggcgtcactggtggtggcagcgctacccccgtttacccatccaccaccgatgagctggtctcatacctcggtgacagcgaggcgcgtgttatcattctcaccaagaccttcgacttcacaaacactgagggcaccgagactagctcgggttgtgctccctggggtactgcctccggctgccagcttgccatcaacaaggataactggtgcaccaactacgagcccaacgctccgaccgtgagcagcatcacctacaacaaggctggtgttctcggtatcaccgtcaactccaacaagtccatcgtcggccagggcagtgccggtgtcatcaagggccgtggtctccgtatcgtcagcggtgccaagaacgtcattatccaaaacattgctatcactgacatcaaccccaagtatgtctggggtggtgatgccatcactctgaacgaggccgaccttgtctggatcgatcatgttaccactgcccgtatcgcccgtcagcacatcgtcctcggtacccaggccgacaaccgtgtcaccatctccaactccctcatcgacggtcgcaccgactactccgctacctgcaacggccaccactactggggtgtttaccttgacggctccaacgacatggtcaccatgatgggtaactacttctactacacctccggccgtatgcccaaggtccagggcaacaccctcctccacgccgtcaacaactacttccacaatattgagggccacgccttcgagatcggctccggtggctacgtcctcgctgagggtaacgctttccagaacgtcgatgcccctgttgagtcccctatcagcggacagctcttcagcgcccccgatgccaccaccaacgagcagtgcaagtccgtcttcggccgtgcttgccagatcaacgccttcggcagctccggttccttcagccaggctgataccgccgtcatctctaagttctctggcaagaacatcgctacagctcaccttgctcagaacatccccaagtgggttatggccaacgctggccagggcaagctctaa

SEQ ID NO: 2110 - protein, 361 aa, Aspergillus oryzae
AGVSGSAEGFAKGVTGGGSATPVYPSTTDELVSYLGDSEARVIILTKTFDFTNTEGTETSSGCAPWGTASGCQLAINKDNWCTNYEPNAPTVSSITYNKAGVLGITVNSNKSIVGQGSAGVIKGRGLRIVSGAKNVIIQNIAITDINPKYVWGGDAITLNEADLVWIDHVTTARIARQHIVLGTQADNRVTISNSLIDGRTDYSATCNGHHYWGVYLDGSNDMVTMMGNYFYYTSGRMPKVQGNTLLHAVNNYFHNIEGHAFEIGSGGYVLAEGNAFQNVDAPVESPISGQLFSAPDATTNEQCKSVFGRACQINAFGSSGSFSQADTAVISKFSGKNIATAHLAQNIPKWVMANAGQGKL

SEQ ID NO: 2111 - DNA, 12195 bp, Pseudoalteromonas haloplanktis
ttactttctttgttgctaagtgaatttaagtactgctgcaaaacctgtgctgtagttgcattttttaattgcggctgatgctgtttgaaccagtcatccgcaacaccatcttcattagcatcaacgattgcgggagcccctgtaaattcctgtttatatgcatcccaattaccaattagctcaaactcatgatcaatcaaaccatttttctttatcgtgacactatcagtgagctgttgataaacaagcgtatcaatactgtcatggaaatagccatgtgcattacgacttgcacctatatgttgccccttaatggcatcactaaatgcttgctttgcattaacataaaccatcgttgtttgcatgggtgatgtaatgattgcttgatcacttaaccactggctattttcatcactaatagtgcgttttgctttaaccgctttgcgataatttacacctaaataattatgctcagtcagttgtgggttattctccagtacattacccataatatatgcctgattttcttttgatctctgggggaataccaaatataagcaaaactgcatgatcttacttgctttacccggcttatagtaattattaatcaagttaaagcgaccattttctgatccataaacattattatgtccccagttaaaaataatattattgataagctcaacaaactcttcattttgtgaatacggtgattttagcctatgaccattgagcctaggagttctactggcatgattggcaattatattattaataaagctcgcatttaccccgccccaaatgccaccataaccatgatcgcctttagggtgaattgaatggcttaaactatgtgaaataattgaatcttgtaacgtaaagttatggttattataaaagctcgcgctttcatccaccgaccaactcaatgaacaatgatcaataatgacattctcactattacgcaccgttaatgaatcatcagcatagccaaatgtgcctaagcgaaagcgcatatagcggataatcacattatctgcggatgagaccgtcacaggagcaccaacaatggcaatcccacctggcgaactttgccccgcgattgttatattaccatgagatattttaagttccccttccaatttgatcacacccgataccgcaaatacgacagtgcgaggatgtttttgcacaattgcatagcgaaggctgcctggttgcggcttatctaaattatctttccaatgtagtcactctataaagcgtgccattaactcctcctggtgcgtatttaccaaatccttttgccgttggaaaagccaatgttgtattgacttgtgcagagtataaattagtcgaaacaaaaaccgtcaacacagtaatgatgcttagtattacgatattgagatagtttaaattattattcttcagaacttgcataatgttccttggctatttcgttttaatgctggttaaaataaaaaattgtcaatatgtaaattgacagttttattaatacagtgttaacttcatgttattccactttgccaccggtggcaatcttgggatttaaatcaacgggaatcgcatatcttgcacacacaattaaaagcctggaaaaggaacaaagatgaagagcatgagactaagcacgatcgcagcagcattaatggtagctatgccactttatgcacaaacggccgatcctgtacagccaaaggtagaaaataatacacaaaaaaccacaaccaatgctgaacaagaaccaaccaaatcagcacaaattgttgaagacgatatagaaataatagctgtaacgggtgtttaccaagctgatttaaaagcacgcgctatggaacgtgacagcaaagcgtttagctctgtgattgccacggatgacatgggtaactttgttgaccaaaatgttgctgagtcactgcgtcggataccaggtgtcactttagagcgcagtgaaggtgaaggtaaatatattgcagttcggggcttaggccctaaattcgtatcggtgagcatgaatggtgcagaactatctggtgcgggtgatgaacgtaaaattggccttgatggcatcactagtgattcattaggagccattgaagtatttaaaacccttacccctgatatgaatctaaattcgataggtggagcagtaaacgtcaaagctatctcagcatatgaccgtggtaaaaacaccctaaaaatgaagctgcaaaattcatacagtgaactcagagaagaacactcgccgaagtttagccttgatggcacacagctattcttagaagaaaaaataggcgttggttttgcactttcttatgaagataggaaaaatcaagtagatgaggtacgccatcatagcactcgagaattaaactttttacaaggtggcattggcctcagtgaagagcaattaggtgtggcacctgaaatattgatccccgcgcaactcgaaaaccgccgtgaaatagctgaccgaacacgtaccaccgcaactctaaatgttgagtttaagccaaccgcaaacagtttttattacatacgaggtaactactctaattacactgatgatgacgtcgcacaaagagagttttataacttttataatggcgaccaagcagatgaaattatttatgtaaatgctgatacaaaagagtttgtcctgtctgatatcgatatttacaaccaatttttcattcaggaaggtgaaacgactacaaccaattacagtatcggtggtgaaaactatattaccgacactttacgcgtagattatgaatatgcgtattcaaaaacagatgataaatctgtgggtgatcgtcgcgtgcaatttcgtgagcgtgagaatatcgtctacggtcaagcaactaaaaataatattgttgcacaggtgcttactcctgaagaagctgctgccctaggtggttttgcgttagatccagacaatgatgtttttgccggtgaagccgatggtgatatcagcgatttatcaaatatggaatacgacaacttatttatggaagacagtgtacgcactgatgaagtcacaagtatcaagctaaacttgcaaaaagactttgatattgagtatcttaattttattaaaattggtggtacttacaacgaacgcgaacatttccgcgataaagatcgctggagctatgcaataaacccactcgattgtggaacggatgaaacctgtattaccgtcgccaactcaaatgttactgattataactttgcggttcctgagggtggcttatttagctatccttttgttagcaacgaagaccttgagtacatagttgactcaactaaaattacgcgcgacagtgctaccggtggcgaggtgtcaattgacagcaccaaagaagactataccttatacgaagatacctacgcagcttatattatgactgagctgcagctatcagagcaagtcagtgttattaccggtgtacgctatgcgcatactgagttttcttcaactggatttatgtcgcttgaaaacgatgactgggattttggcaatgacaaaatgcttgatttagcaatcccactacctgaatcgtcaattacctatagtgagtttttcccgagtattcatgttcgctatgagccgagcgatcaaattttggtacgtacttcattatggaccagttacacccggccttcttttaaacaagctcgtggttttgctaagtttgatgacgacataagcctatgcaatccaacaacgaacaactgttacagctcgccagatggacagagcgccattgaccttcaaggttatattttaggacccgataacgcagtacaagttggtaatcctaatctagtagccatgacatctgacaactttgatgcatcatttggctggtatccatcaaaagagttatttatggaagctgcggtattttacaaaaatatcgataacttcatcgtcgatgtcaccggtattcaaatggggatagacgaattaccactgactttaccagttaatcaagtgtctgactttgcaattccacaagatcttgttcttaatcaggtcgatataactttaaacggcgataaagcgactgtttatggtattgaattgagttacaaccagttctttgagaatggcttattttggcaaagtaatatgacatttgtaaaaagtgaagctgagctcgatgccactattcgtcatgataaaatgccactgcctggtcaggctgacgttaccggtaatattgcggtgggctgggaagatgagtcattctcattgcgtctaattagtaattaccgctcagatattcttgaagaggttggctcttgtcccgtatcagcttctgtatcagacccacatacctgtaagtcatgggctgatatctaccaagacgatatcttaacctttgatatgaaagtgaaatatgactttacgaaaagcctcagcgtgtattttgacgcgattaacttaaccgatgaatcagatttacgttatttcaaaggtaatgatttatccggtggtgaaatcctctatcaacgtgaagattatggtcgtacgttccagttaggtatgaattataagttttattaacagctactaataatgaaaaacgttaatttcacacacaattaacgcgttaatgacgcgctttcatccttggagggatgcatgaacaatacaataaaaataccatcgtgtttgctgatcaccgcgatcttagcaggctgcggtgaagatagttctatcaatgtcaaagaagctccgttaccaccagtgcaagggatatttgttgacagccctgttgctggtttaacctacaacagcccatcaataagcaatggtgtaacaaacgcaaatggacaattcgattactttagaggtgaagctatcgatttctcaattggtgcacttacctttcctacggtctctgccgccaatgtattaactccacttgctttgttttcgacagataccgtgtttcatcctgctgttattaatagcttgcgtttattacagtcactagatgttgatggtgatcctagcaatggcatcaccatcagcgagcaagcagcacaaacagccgttgtgactttagcagaagggcaaacgattacggactattttagtagcgatgagtttgaggcgaatgttaatgcgtggctcgctgatgcaggttcagctaatagtaccttaattccagctgatcaggctattgtgcactttgttgattatatttttaagcaatacaacagcacgcaacctttagcatttaatactgccgattttagcggaacaatgtataacccattagtacaaggcagtgaggcaattattacacagttgatgttaacgcccgttgatgaatcaaaccttagtggaacattcagccaagtagtgggtgacagcgaaacagtaacaggccgttattcgtttttattcggtaatcgtgtactagcactgatctcaggtgaaggtgaactgctacaacccagtatattatttctcgctctcataatacggttaataacacctatagtgtttgtgccacaagcggtccaaacgcattggcaacactggtgcttatttgtgatagtaatgatgatgctaaaaacaatattttagtgttctccgaacaacaagcccaagaagagttagtcaaactcaacgatttagctcagcaagctggtttagtcttaattgaagagtttgatactgacactgaaacatttttctcatcgagctataaaagcttatcggatgagcaaggcagcggcccgttatattttaaaagtggcggtagcgcaaaaattgacgatgtagcaggccaactaattcttgaaggcggccgtattaccatcggtaataccctgcccggcaaagaatcaacagcgactgatagctcaggtgtggggatttataatttaagcgaagggtttaccattagctttgatattatttctcataatagtgctggtggattatccctgtatgttgataataatactgccagtcaaagtaattcagtgcatggcggtgcttcaaagttttatggtaaagacataaacgaaagcaatacccctgcaggtcaacggttttcatatacctacattccaggcgaagatgtaaatactggcccagatctgactaatatcgatgcccgcggtattttaaatcctgagattaaaaattcatatttccaaatacgcactgattcagcggcaatgattgtcattgataacttaaccatcaaaacagtggcaaccgacgtaccagatgtcgagccacctgttgaaccaccggttcaaggtgagatcccaacagtagaattaccaattaccactgactttaccgcacttactgctgatattttctctgttgaacatcaaaaaattattgatactaacggcgatgaaatcccaatgtttagcaaaacaggcggctcagtcactgtgattgatactggattagagcttaatggaggtcgtttcacattaggtaacaccaccccgggtattgaaacagcagcaacggataccaccaccagtggagcgctggatttgtctcgtccttatcaagtggtgatggatattgtcagtataagtgaccctgaaggtgataataaattccaaatttatgtggataacaactcatcaagcagctctaaatcaatccatggtaatgactcacgtttttataatgaattgatcaactcgcttactgctggccaaactttaacagtacccggaaagcttgcgactaaaaactcatttttacagttacgtaccgaaacaggtggcactgtggttatcaataacctcagagttgagtatgttaaagatccatctgtatttagctgcacggatgcacctgaactgtatttttgtgatgattttgccaatggtgatttaaataattggcaagttttagccaagccagataacactgaagccccaatgggtgagtttgatgtacttgatatcatgggtaataacatgatgcgatacaccgcaggcggtgctggtggcgagctaattttagctactgaagaagctatggcaaacgtgcctgtcacaggtaactactttgttgaagcgaaaattcgcccacgtcagaactctaccacggccaataagcacatttttttgatggcacgctatttaaatgccggtaattggtacgctggtggtttaaatgtgcaaaactcatcaagcagtacgcaagtggaagttgccgttagtagcgaagggtcgattgcgcgtccagtgcaaacaaaatcaccaatcttactcggtgaaaaaggcgcaatagaagatggtgtttggtacaccactcgctttgaaatgattgatgatcaacttaccgtatacttagatggtgagaaaatgggctctgcgactgataccagctatacagcgcgtggcttaattggtgtgtttacgaataatcgttcgtttgaaattgatgatgtaaaagtgggcgaccctagcatcaagccaattcagttaacccttgattacaaagagcctaattgggacacaagtaccagtatggatccattgttgatcaacgttacagcgattaaaaacgacggtatcacagccggcacctacacagtcacttcaagcaatgaagcagtggtgagcgttgcaatcaatggaaatgcgatcacccttacaccgattactgtaggcgatgcaatggtcacatttgtatcggattcagacccaagtattacacgtactattaaagtctctgttgcagaaggctttgttatgccaaccgctgactatggtgatttaacagataaagtgatgccagcgattgctagcgatagccaatttgttgatacccagttatcgattacttttgataacgcccctacgtttggtagtttaggtgaaatacgtatttataaacaaaacgacaacacgcttgttgataccctcaaagtgggtaaaaacgtcgatgtgattggttacacaggccaagatagattgcgctctgtgtactactacccgctcacgattgaaggcaataccttaaccattaaaccgcacaataatgtgcttgaatatggccatacttatcgtgttgtcattggtgatgatgtggtactgggcgcacaactcaacggtactgattttattggcctcggtgataatagccaatggacgttcaccactaaagtgacaatgccggcaagcaatcaactactggttgatgatgacggtgtagctgactttagaaccgtgcaaggtgcacttaactttgcaatggcaagtcttgctaaagatgagcaaaccaccatttcagtcaaagatggtgtatataatgaactgctattcttacgtaataaagataacgtaactatacaagggcaaagccaagacaatactactattcagtacgaaaactacgaaacactcaatggtggctcaggtggcagtgcgcctataggttctggcacaccgggcggcggtcgtggtgtattcttagttgaaggtgcggatatgttagtgatcaacaacctaacattgaaaaacacccacttgcgtaacaatgttgattcaaaccaagctgaaactatttactttaatagtaatggtcgtttagtggctaataatgccagctttattagcgaacaagataccctattacttaaaggttacacttggttttacaatagcttagttgcaggtaatgttgactttatttggggctacccggtcactgcattatttgaagacagtgaaattcgcaccattggtgactccaaagatggtgatccaactaaagactcatcaggtggttatgtgttacaagcccgcgtacctgtgcaaacagatcctggctttatcttcttaaataaccgctttactcatggcccaggaccaattggcaataatgtgttagataattcaacctatattgcacgcagtggtggcagtgacacatattttgataatgttacgcttatcaataataagtttgatactcacattgcaacctcaggttgggctgtgcaaggagttaacagtcaacctgcaccaaatccagaaattgcaacggctaccagtggctggcgcgagtatggcagcatggatttagcaggtaatactcttgatttaagtgcccgtgttggtggttacattatgcaagacagcgacgtggttaacttacttgagcgtaacgctatttttgcaagctttaatgatggccaaggttggacacctgaaccactcgctatcccaatcttgccagatgagccaattgcaataacaccggtgaataatagtctaggttttgctggttataattttagcctaaccggtggcgaaggtggaacagtagtgaccgttgataatggcacagcgcttaaatcggctttagcacaagcaaaatcattaggtgttccagagactatttatgtcgatggtgtcattactgatgcaaacagtggcggcgataattcttctatcgaaattaaagatatggataatatctcaatcattggtgtggcagatcgtggtgagctaagtggtatcggcattgctattcgtcgtgctaataacatcattatccaaaacttaaaaatccatgaagtacttaccggcggtaaagatggtatttcgattgaaggtgatgaaaataaacctaccgcgaatatctggattgatcataacgaactctattcatcgttaaatgttgatcaagattattatgatggtttaatcgattctaaatcgggtgctgaaaacattaccatttcatataactatattcacgatagctggaaaacgtcactccatggtcacagtgatgatgactcgagcagcaacaagaatcgtcatattacctttcaccataaccgctttgaaaacatcatatcgcgtgttccgttgtttagatttggtcaaggtcatatattcaacaactattataacaatatcacctctagcgcgattaactcacggatgggcgcagagctacatattgaaaataactactttgagcatactaaaaatcctgtggtctctttttactcaaaagtaattggttattggaatacctcgggtaactacctaggtgaaggtgttacttggggtgatgtggctgacggcgatgtggctgcagaggttactgccactggtatgacacccaccagctcataccaagcaccttacgagtataagttaacaccagtaatggatgttaaagcgcatgttattgcccatgccggcattggtaaaacggatcaaagcgatttagacatccctgacattgcaccgccaagtgaaccacctgttcaagagccgcttgggttaccctttactgaaaattttgctgcagcgaatacggacgagttttttagtaatagttatcgtgacttatcgggcttagctggatctggtacgccgctgttccaccgtgtaacaggcgctattgatgtatcagcaggccaattaaccatgacaggggcacgcattagtatagcgaatactacccctgcggttagtacaacctcagcagatgcaagcaccacggggttacttgatttaagtaacagttatcaagtgagctttaaagtcgtgactgtagcaggcaatactgcaaaagcttccaaaatatatgtagataacaacacctctggtagcgctaattcaatccacggtggttcatcgaagttctactcagtacagcttcaagacttagtcccaggtcaaacggacaccgtcgatgggttggtagccacagctacctcattcatcactctcagaacggaaagtgaagcaactatcacattggatgaaataaccatccaatagttgtaatgggagaagccaagcgctgctttcacacaatttgatagttaccaataccctcgccccgtacagcaagggtatttttttatccatatcattcctttctctttgtgcaataaaatcttcaagttaataattcacaaagagattaacaggcgctgcggttaaagagcgagggcatgaagttaacgttattaaattgagttagaaatttttcaagtacgactgcatagatgcaggagatagagtaatgcaggagcaattgccaagaacaccctatcaaaatttctgccttgttatcactgtatttatctgtcgctataaatggtcagtaacttaatacgattaatatcaggcggtgcttacagcgctcaaaatgttccagatattaaaaacgagcgctatgcattttatcctttaggcagcatatcggccgtttcgtttaacaccgatatttcatgctcttttatcaaaggtgctcctcaaatttaattaactcatgaattaaatcaaaaaattatcattggattacggataggagtaagcgccctagtgtcagtaagacgctttgtatgcctgtaacaaaaatattatgagagggggttaatcggtactatttagcgcatctgttggtagattcacgcttcactaaataaggggtgactacggtcatctaatttaattttttcactttgtgtcgattggcttttattgatgagtttttgcaccgcataaacatgccatattttgtaccggtcttcgaatagtcgttagcgatgaatttttattgatgagtttttgcaccgctaaacatgccatattttgtaccggtcttcgaatagtcgttagcgatggaatgatccttgaagccaaaatattatcatcaaaacctgccactgatagctgttctggtactttgatatttaaattactggcaacccgtaatacccccgccgccatttcgtcgttgttagcaacaatggccgttggtcttggttcagtgcttaacaacgttatagcgcattcaataccactttcgtaactattttttccttcaataatacgatttccaggcagttgcacattacattgttgcagttcagctaaaaagccggctaagcgttcgattgaagaacgataaacttgcggtccagaaataaaaccaatgtctttatggccaagttcaaccaagtagctggccatttctttcattgcttcgcgttcgtctgagaccacaatgttatcagcatcatctaaatctaccgatgctaagcgcacataaggacaaccagcttcacgaattgctgcagctaactctttgttctcagatactggcggtaaaataatcacgccatcaagctt

SEQ ID NO: 2112 - protein, 338 aa, Pseudoalteromonas haloplanktis
MRFRLGTFGYADDSLTVRNSENVIIDHCSLSWSVDESASFYNNHNFTLQDSIISHSLSHSIHPKGDHGYGGIWGGVNASFINNIIANHASRTPRLNGHRLKSPYSQNEEFVELINNIIFNWGHNNVYGSENGRFNLINNYYKPGKASKIMQFCLYLVFPQRSKENQAYIMGNVLENNPQLTEHNYLGVNYRKAVKAKRTISDENSQWLSDQAIITSPMQTTMVYVNAKQAFSDAIKGQHIGASRNAHGYFHDSIDTLVYQQLTDSVTIKKNGLIDHEFELIGNWDAYKQEFTGAPAIVDANEDGVADDWFKQHQPQLKNATTAQVLQQYLNSLSNKES

SEQ ID NO: 2113 - protein, 989 aa, Pseudoalteromonas haloplanktis
MKSMRLSTIAAALMVAMPLYAQTADPVQPKVENNTQKTTTNAEQEPTKSAQIVEDDIEIIAVTGVYQADLKARAMERDSKAFSSVIATDDMGNFVDQNVAESLRRIPGVTLERSEGEGKYIAVRGLGPKFVSVSMNGAELSGAGDERKIGLDGITSDSLGAIEVFKTLTPDMNLNSIGGAVNVKAISAYDRGKNTLKMKLQNSYSELREEHSPKFSLDGTQLFLEEKIGVGFALSYEDRKNQVDEVRHHSTRELNFLQGGIGLSEEQLGVAPEILIPAQLENRREIADRTRTTATLNVEFKPTANSFYYIRGNYSNYTDDDVAQREFYNFYNGDQADEIIYVNADTKEFVLSDIDIYNQFFIQEGETTTTNYSIGGENYITDTLRVDYEYAYSKTDDKSVGDRRVQFRERENIVYGQATKNNIVAQVLTPEEAAALGGFALDPDNDVFAGEADGDISDLSNMEYDNLFMEDSVRTDEVTSIKLNLQKDFDIEYLNFIKIGGTYNEREHFRDKDRWSYAINPLDCGTDETCITVANSNVTDYNFAVPEGGLFSYPFVSNEDLEYIVDSTKITRDSATGGEVSIDSTKEDYTLYEDTYAAYIMTELQLSEQVSVITGVRYAHTEFSSTGFMSLENDDWDFGNDKMLDLAIPLPESSITYSEFFPSIHVRYEPSDQILVRTSLWTSYTRPSFKQARGFAKFDDDISLCNPTTNNCYSSPDGQSAIDLQGYILGPDNAVQVGNPNLVAMTSDNFDASFGWYPSKELFMEAAVFYKNIDNFIVDVTGIQMGIDELPLTLPVNQVSDFAIPQDLVLNQVDITLNGDKATVYGIELSYNQFFENGLFWQSNMTFVKSEAELDATIRHDKMPLPGQADVTGNIAVGWEDESFSLRLISNYRSDILEEVGSCPVSASVSDPHTCKSWADIYQDDILTFDMKVKYDFTKSLSVYFDAINLTDESDLRYFKGNDLSGGEILYQREDYGRTFQLGMNYKFY

SEQ ID NO: 2114 - protein, 317 aa, Pseudoalteromonas haloplanktis
MNNTIKIPSCLLITAILAGCGEDSSINVKEAPLPPVQGIFVDSPVAGLTYNSPSISNGVTNANGQFDYFRGEAIDFSIGALTFPTVSAANVLTPLALFSTDTVFHPAVINSLRLLQSLDVDGDPSNGITISEQAAQTAVVTLAEGQTITDYFSSDEFEANVNAWLADAGSANSTLIPADQAIVHFVDYIFKQYNSTQPLAFNTADFSGTMYNPLVQGSEAIITQLMLTPVDESNLSGTFSQVVGDSETVTGRYSFLFGNRVLALISGEGELLQPSILFLALIIRLITPIVFVPQAVQTHWQHWCLFVIVMMMLKTIF

SEQ ID NO: 2115 - protein, 1749 aa, Pseudoalteromonas haloplanktis
MLICDSNDDAKNNILVFSEQQAQEELVKLNDLAQQAGLVLIEEFDTDTETFFSSSYKSLSDEQGSGPLYFKSGGSAKIDDVAGQLILEGGRITIGNTLPGKESTATDSSGVGIYNLSEGFTISFDIISHNSAGGLSLYVDNNTASQSNSVHGGASKFYGKDINESNTPAGQRFSYTYIPGEDVNTGPDLTNIDARGILNPEIKNSYFQIRTDSAAMIVIDNLTIKTVATDVPDVEPPVEPPVQGEIPTVELPITTDFTALTADIFSVEHQKIIDTNGDEIPMFSKTGGSVTVIDTGLELNGGRFTLGNTTPGIETAATDTTTSGALDLSRPYQVVMDIVSISDPEGDNKFQIYVDNNSSSSSKSIHGNDSRFYNELINSLTAGQTLTVPGKLATKNSFLQLRTETGGTVVINNLRVEYVKDPSVFSCTDAPELYFCDDFANGDLNNWQVLAKPDNTEAPMGEFDVLDIMGNNMMRYTAGGAGGELILATEEAMANVPVTGNYFVEAKIRPRQNSTTANKHIFLMARYLNAGNWYAGGLNVQNSSSSTQVEVAVSSEGSIARPVQTKSPILLGEKGAIEDGVWYTTRFEMIDDQLTVYLDGEKMGSATDTSYTARGLIGVFTNNRSFEIDDVKVGDPSIKPIQLTLDYKEPNWDTSTSMDPLLINVTAIKNDGITAGTYTVTSSNEAVVSVAINGNAITLTPITVGDAMVTFVSDSDPSITRTIKVSVAEGFVMPTADYGDLTDKVMPAIASDSQFVDTQLSITFDNAPTFGSLGEIRIYKQNDNTLVDTLKVGKNVDVIGYTGQDRLRSVYYYPLTIEGNTLTIKPHNNVLEYGHTYRVVIGDDVVLGAQLNGTDFIGLGDNSQWTFTTKVTMPASNQLLVDDDGVADFRTVQGALNFAMASLAKDEQTTISVKDGVYNELLFLRNKDNVTIQGQSQDNTTIQYENYETLNGGSGGSAPIGSGTPGGGRGVFLVEGADMLVINNLTLKNTHLRNNVDSNQAETIYFNSNGRLVANNASFISEQDTLLLKGYTWFYNSLVAGNVDFIWGYPVTALFEDSEIRTIGDSKDGDPTKDSSGGYVLQARVPVQTDPGFIFLNNRFTHGPGPIGNNVLDNSTYIARSGGSDTYFDNVTLINNKFDTHIATSGWAVQGVNSQPAPNPEIATATSGWREYGSMDLAGNTLDLSARVGGYIMQDSDVVNLLERNAIFASFNDGQGWTPEPLAIPILPDEPIAITPVNNSLGFAGYNFSLTGGEGGTVVTVDNGTALKSALAQAKSLGVPETIYVDGVITDANSGGDNSSIEIKDMDNISIIGVADRGELSGIGIAIRRANNIIIQNLKIHEVLTGGKDGISIEGDENKPTANIWIDHNELYSSLNVDQDYYDGLIDSKSGAENITISYNYIHDSWKTSLHGHSDDDSSSNKNRHITFHHNRFENIISRVPLFRFGQGHIFNNYYNNITSSAINSRMGAELHIENNYFEHTKNPVVSFYSKVIGYWNTSGNYLGEGVTWGDVADGDVAAEVTATGMTPTSSYQAPYEYKLTPVMDVKAHVIAHAGIGKTDQSDLDIPDIAPPSEPPVQEPLGLPFTENFAAANTDEFFSNSYRDLSGLAGSGTPLFHRVTGAIDVSAGQLTMTGARISIANTTPAVSTTSADASTTGLLDLSNSYQVSFKVVTVAGNTAKASKIYVDNNTSGSANSIHGGSSKFYSVQLQDLVPGQTDTVDGLVATATSFITLRTESEATITLDEITIQ

SEQ ID NO: 2116 - protein, 217 aa, Pseudoalteromonas haloplanktis
KLDGVIILPPVSENKELAAAIREAGCPYVRLASVDLDDADNIVVSDEREAMKEMASYLVELGHKDIGFISGPQVYRSSIERLAGFLAELQQCNVQLPGNRIIEGKNSYESGIECAITLLSTEPRPTAIVANNDEMAAGVLRVASNLNIKVPEQLSVAGFDDNILASRIIPSLTTIRRPVQNMACLAVQKLINKNSSLTTIRRPVQNMACLCGAKTHQ

SEQ ID NO: 2117 - DNA, 1695 bp, PENICILLIUM GRISEROSEUM
  misc_feature (532)..(532): n is a, c, g, or t
  misc_feature (884)..(884): n is a, c, g, or t
tctcattcacactggcttccgaaacaaccactctcaccacatccactctcatttcagccggggattatccgagtagaggatctaaggggaaggaggcattgaattggcggaacattgaaacacatctcataacctaaaatcgcagttatataagtaacatcattcgtccttcttccatccattccctctctaatccattctctctttgcctttcttttgtgcgcttcataattttgtttgctttttgtttaccgtcactcttttatatactacctatatcaacttcgaaaatgaagtacgcatttgttctcacggccattgccgctattgcctccaaggtcgccgctgttggtgtctctggcactcctgagggtttcgcttcttccgccactggtggcggcaatgctacccctgtctaccccacctccaccgatgagctgggctcttacctcggtgatgacgaggcccgtgtgattggtctggccaagacgtgagtagagagctcctaccgtggatgcatggccgctaactntggcggaatattagtttcgacttcaccgatactgagggtagcaccaccacttccggttgtactccttggggtactggctccgcctgccaggttgccatcaacaaggatgactggtgcaccaactacgagcctgatgccgctaccactaccgtcacctagttagtatcccatcacccgggctataatcgtcatcccctcgatgctgacacttctctaagcaaaaacgccggtatgctcggtatcaccgttggctccaacaagtccttgattggtgagggcaccaccggtgtcatcaagggtcgtggtctgcgcatcgtcaacggtgtcaagaacgtcatcgtccagtatgttngatcccgtgtcggtcttaagcgtaaaagcatcgttggaatacacgctaatcggcttaccataggaacatcgctgtcacagacattaaccctcagtacgtctggggtggtgatgctatcaccatcaaccaagctgacctggtctggctcgaccacattaccgtgcgttgctcccacagaacatcccaacaatttgcatagactgacttgtctcatctagactgctcgcattggtcgtcagcactacgtcctggtactgaggctgacaaccgtgtttctatcaccaacaactacatcaacggtgaatccgactactctgccacctgcgacggccaccactactggaacgtgtaccttgatggctccagtgacaaggttaccttcaagggcaactacctctacaagaccagtggccgtgcccctaaggtccaggataacacctaccttcacgctgtcaacaactactgggacgagaactccggccacgccttcgagattggcactggtggcgtaccgttcttgcggagggtaactacttctcttaacgtgaaccgaggttcttcgagtcatcctccttccagggtgccctcttctccgccgacaccgactccagcacctgctccgcctttatcggtcgcttcctgtgtcgttaacgtcaacggaggcacccttgaccggcacttccggttgacgttttggtcggtcttcaagggcgagactctccccctgtccgccgttgctagcactgtacccccttggcagccgccggcccagggtaacctgtaaataaatgttggagcgatcgagtttggg

SEQ ID NO: 2118 - protein, 383 aa, PENICILLIUM GRISEROSEUM
MKYAFVLTAIAAIASKVAAVGVSGTPEGFASSATGGGNATPVYPTSTDELGSYLGDDEARVIGLAKTFDFTDTEGSTTTSGCTPWGTGSACQVAINKDDWCTNYEPDAATTTVTYKNAGMLGITVGSNKSLIGEGTTGVIKGRGLRIVNGVKNVIVQNIAVTDINPQYVWGGDAITINQADLVWLDHITTDLSHLDCSHWSSALRPGTEADNRVSITNNYINGESDYSATCDGHHYWNVYLDGSSDKVTFKGNYLYKTSGRAPKVQDNTYLHAVNNYWDENSGHAFEIGTGGVPFLRRVTTSLNVNRGSSSHPPSRVPSSPPTPTPAPAPPLSVASCVVNVNGGTLDRHFRLTFWSVFKGETLPLSAVASTVPPWQPPAQGNL

SEQ ID NO: 2119 - DNA, 1734 bp, PENICILLIUM GRISEROSEUM
gagctatctatactggactacttgttgatcctatataaggtcacgtccatcgcgcccaaatctctctttcagctctccatcccaaccattacattcttttatacaggtagaaactaccaactcccaacatgaagatcgccgctatctttgcagcactcgctgtgcgagctgccgccgtcggtgtcaccggcgccgcagagggtttcgccaagggcgtcactggtggtggctctgccacccctgtctaccccagcaccacagccgagctggtctcgtacctgggtgactcttcccctcgtgtcattattctcaccaagaccttcgacttcaccggtactgagggaactacctccgccactggctgcgctcttggggtactgcctcgcttgtcaggttgccatcaaccagaacaactggtgccagaactacgagccgaacgcgccctcacctttgaatagtatgcatttcaaccctccaaaccctttggtattaatcaatcccggaaaagtcaaaactaaaagacggttccaagacaaacgccgggtgttctgggaataccggtcaagtccaacaaagtcaatcgttggttcgggcagcggtgtcatcaagggcaagggtctgcgtatcgtaagcggcgcgaacaacgcatcatccagtaagatattaaccaccctgctacccccaaaaaaccgattaattaaacccattccaccccaaggaacgtcggccatcacccgaaccatcaaaaccccaaagtacgttttggggcgggtgacgcccatcacccatccaacaacggccggacatgatctggatcgaatcacggtaaccacccgcccgtatctctcgccagcacatcggtgctcggcaccgagggcctccaagcgtgtcactatctccaacagcttcatcaacggtgccagcgactactccgccacctgcaacggataccactactggggtgtctaccttgatggatccagcgatctcgttaccatgaagggcaactacatctaccacaccagtggacgtgcccccaaggttcagggcaacacccttctccacgctgtaagtgaaacaaacacccgaccaacagtcatttttaatttccagatgacaaaccactttctcgggattacctcaaatcccctctttttggaaatataactaacacatacgctaggtcaacaactactggttccagaactccggccacgccttcgagatcggcgctggtggctacgtcctcgctgagggtaacgtgttccagaacattgttgcttctgtcgagactcctattgctggacagttgttctcctcccccgatagcaccaccaacgctgtctgcagctctcacctcggccgtgcctgccagctcaatggattcggatcttccggaaccttcgatggccgtgctgatactgcattcttggccaactttgctggaaagaacattgcttctgcttccgcttacacttccgttgttgccagtgttaacgctaacgctggtcagggtaagctttgaagtggagttgagtgtgatttactcgtgcggagggaagttgtgaggtgacgaggggaaggttgggagagggagaggtagttggcgattgtcgtgtattaatttaaacaataagatctctatgtgatctattagcattaataggaaatcatttgatttattgagaagagtaacaagactagaactagttcgagttggcgagatggacaact

SEQ ID NO: 2120 - protein, 380 aa, PENICILLIUM GRISEROSEUM
MKIAAIFAALAVRAAAVGVTGAAEGFAKGVTGGGSATPVYPSTTAELVSYLGDSSPRVIILTKTFDFTGTEGTTSATGCALGVLPRLSGCHQPEQLVPELRAERALTFEYGVIKGKGLRIVSGANNASSSKILTTLLPPKNRLIKPIPPQGTSAITRTIKTPKYVLGRVTPITHPTTAGHDLDRITVTTRPYLSPAHRCSAPRASKRVTISNSFINGASDYSATCNGYHYWGVYLDGSSDLVTMKGNYIYHTSGRAPKVQGNTLLHAVNNYWFQNSGHAFEIGAGGYVLAEGNVFQNIVASVETPIAGQLFSSPDSTTNAVCSSHLGRACQLNGFGSSGTFDGRADTAFLANFAGKNIASASAYTSVVASVNANAGQGKL

SEQ ID NO: 2121 - DNA, 1939 bp, Aspergillus niger
atgttgtccaaaacgtcgcttctgtcgctcctctcgcttgcagctggggtcgtcaatgcagactttggcataacgaccagtgattcctatgtcataaacgccaattctcccaactcgttggtgtttaccgttgaccgcggaagttgcgatatcacttctatcgtgcattatggcacagagctgcagtattccggcaagggtagccatatcggctccggtcttggaactgcgacagtttctgctactaagagcggtaagtggactttgagtacgcgagagtgacaagctgattaggagcaggcgactacatcaaggtgacctgtgagacggacacattgacccagtatatgggtgtccatgatggggaccgtatcattcatatggcaacctacattaccgagggtgagtattgtgtcaaagttttctacgttagtctctaacatccaccagagccatctatcggtgaattgcggtttattgctcgactcaactcagatgtactccccaacgaggagccattcggcgatgtgtccaacactgctgatggggagccgattgaaggatctgacgtggtatgtcttctgggggatttcgatgacgttgctaatttcacggcagttcctcgtcgatggcgagactcgcagcaagttctactccagccagcgtttcattgacgatcagagacactgtaagaaatgatggaatatctacagggttatcgctgactattcaaggcattgcgggcgatgagcaccgcgtctgtatgatactcaatcaatacgagacctcttccggtggtccctttcacaggtaggcacataactctctatcgcaaggaatatgctcacagctacagggacatcaactccaacaacggaggtgactacaactccctctactggtacatggtacgtttactactttcttctcaaatccacagctactgaccatccagaactcgggccatgtccaactcgagtcctaccgcatgggtctccacggaccgtactcgatgtacttcagccgcagcggcactcccagcaccgacattgacacgtccttcttcgcggacctcgacatcgagggctacgtagccgaatcaggcaggggaaccgtatccggaaccgcgtcaggcgctgactcgagcttcgactgggtcgttcactggtacaccctttcacccacacaaccatcaaccctagctaaccgggcaggtacaacgatgacgcccaatactggacatacacatcctcctccggcagcttcacctcccccgccatgaaaccaggaacatacaccatggtatattatcaaggcgagtacgtcgtggccacaagcgaagtgaccgtcagcgccggctcgagcacaagcaaggacatttccggctccgtcgaaacaggaacgaccattttcaagattggcgattgggacggacagtaagtctcccccttctaccacacacatcaattacacatctaacacatcatggtatagaccaaccggcttccgcaatgcagaaaaccagctccgcatgcacccctccgactcccgaatgtccgactggggccctctaacctacaccgttggcagctcctccctgactgatttccccatggccattttcaagagcgtcaacagtccagtaaccatcaagttcactgcaacatctgaccagactggtgcagcgacgctgcgtatcagaactacgctgtcgttcgcgggtggacggcctcaagctacggtaggcttcctctttccttcctcctttatgtgcagcgtagctaagatatataaacagatcaacgactacgaaggatccgcgccgtccgcacctacgaatttggactctcgtggcgttactcgtggtgcgtatagagggtatggggatgtttacgatgtttcggttcctgaggggacgattgtggagggggagaacacg

SEQ ID NO: 2122 - protein, 499 aa, Aspergillus niger
MLSKTSLLSLLSLAAGVVNADFGITTSDSYVINANSPNSLVFTVDRGSCDITSIVHYGTELQYSGKGSHIGSGLGTATVSATKSGDYIKVTCETDTLTQYMGVHDGDRIIHMATYITEEPSIGELRFIARLNSDVLPNEEPFGDVSNTADGEPIEGSDVFLVDGETRSKFYSSQRFIDDQRHCIAGDEHRVCMILNQYETSSGGPFHRDINSNNGGDYNSLYWYMNSGHVQLESYRMGLHGPYSMYFSRSGTPSTDIDTSFFADLDIEGYVAESGRGTVSGTASGADSSFDWVVHWYNDDAQYWTYTSSSGSFTSPAMKPGTYTMVYYQGEYVVATSEVTVSAGSSTSKDISGSVETGTTIFKIGDWDGQPTGFRNAENQLRMHPSDSRMSDWGPLTYTVGSSSLTDFPMAIFKSVNSPVTIKFTATSDQTGAATLRIRTTLSFAGGRPQATINDYEGSAPSAPTNLDSRGVTRGAYRGYGDVYDVSVPEGTIVEGENT

SEQ ID NO: 2123 - DNA, 2435 bp, Aspergillus niger
ggatcctcccatcctgacgatcactaggttatcttctcatccgccacccagcgtgccaatcatgattccctctgtgacgcatggaattggagatcgtcagtgtctcagacgagctggagactgtgcgcgggtcataaagtgccgggtcagacttaacagacttgactcgcgggacaagggctcaaaccgttgcacgatcggcgggcgggtgaaaagcaaccagaagatgaccgcggatttttcccgtccgagagtttcaccatgcgatccatgatcaatctgcgacaggctccgccatgattgacatggctgtttccatgttcgcgtcaacttcccgtgcacatatggcagataggcccaaaccctctatggcaggttcttcgagtcttcaactattaaactacctctcgactcagctttggttcagtttccatcaccaagctaactcacacattcacgttcttttcattcgttttcttcagaactgctggttcagtccttcctttcatatccccaaccttgatttctgaggctcgttgcaatgaccctccttcgtcatctcttaacggcaactgccttgctcggagcttcagtccaagcagcgcagggtgtcactggctcccccttcggtttcgctagcggcacgaccggtggcggtgatgccactcccgctgcccccagcgacatcagccagctgaagacctggttgtctgacagcaccccccgtgtcatccttatcgacaaggagttcaacttccttggcagcgagggcaagtgcaccaactgcgagtgctgcaaacccgcctcgaacacctgcggtagctctggccagaatgccgtcaagcagaatggctccgactggtgcggtagctatcccaccctgacctgcacgtacgacaacgccggtattgagggcctggaagtcgcctccaacaagtctattgttggcgtgggtagctctggtgtcctgcgtggaaagggtctgcgcctggtgaacggtgtcagcaacatcattatccagaacatccacatcacggagctcaaccccgagttcatctggggtggtgacgctatcaccctcgacggcaccaacaacgtctggattgaccacgtcaagatcaacctcattggtcgtcagatgttcgttgccggatacgaagccagtatgtttccaaaaatagatgtacattgtttggattcaaaactgacagtgcgcaggtcacagcgttaccatctcgaacagcgagtttgatggtgagaccagctggtctgcgacttgcgacggccaccactactggactgtgtaagttccatgtcgtcccacgcgctcctccttcattacaacatcctaacactatctagtctcggatacggccacaatgacaagatcaccttcgccaacaactacatccaccacacttcgggccgttcccccaagcttgagttcaacagcttctggcacgcgtacaacaactactggtacaacaacactggccatgccttcgatgttggcaagaacacccgtgctctgatcgagggtaatgtgatggtccaggtcgacactcctctcttggccgacagcaaccccggtgccgtattcgccgtgaacaccagcgatgtttccacctgcaccagcaccctcggacgcacctgtgtccccaacactttgatcagctccggtactctctccggtagtgacagctctgtgatcagcagctggccctctggtgagtccgacgtcaccgtcatggctgctagcaaagttgcttcctacgtcaaggccaacgccggtattggtaagctcggcaacggatctggctcctccagcaccgtcggcgcggccgccacctccgctgtcgccaagcgtgccgactctgacgatgctccttttgtcccggcctactctgaggctggccccggcgcttccgctgtccccacccagccctcctggtcttggaggacagtcaccaacggccctgctcccactggagctccctctgatagcccctcggccccccagggtcttggtgctcctgtccaggcttcgaacaagcaccaccaccagggacacggccgtggctactaaagggaatttgtgggttcgcttctgcgctgccaagctgacaatgaagcaagctgagataattcccattttcaacggtctgtgagacaacatttgtgtacatttccgaacattcatcttcttgtacatgatcaggctctagccagatattccctagctagtgtcttatttatcatatttagtcaatctatcaatccttccacatgggtctatctcgctccatacctctgtagcaggcaatataacctatgtagcaatcgtaggctgacatagagtggtatgataagcaggctgcaatccgagtcttgtagcttacgtattcgtatctaccatcattttcctgattgaattc

SEQ ID NO: 2124 - protein, 476 aa, Aspergillus niger
MTLLRHLLTATALLGASVQAAQGVTGSPFGFASGTTGGGDATPAAPSDISQLKTWLSDSTPRVILIDKEFNFLGSEGKCTNCECCKPASNTCGSSGQNAVKQNGSDWCGSYPTLTCTYDNAGIEGLEVASNKSIVGVGSSGVLRGKGLRLVNGVSNIIIQNIHITELNPEFIWGGDAITLDGTNNVWIDHVKINLIGRQMFVAGYEASHSVTISNSEFDGETSWSATCDGHHYWTVLGYGHNDKITFANNYIHHTSGRSPKLEFNSFWHAYNNYWYNNTGHAFDVGKNTRALIEGNVMVQVDTPLLADSNPGAVFAVNTSDVSTCTSTLGRTCVPNTLISSGTLSGSDSSVISSWPSGESDVTVMAASKVASYVKANAGIGKLGNGSGSSSTVGAAATSAVAKRADSDDAPFVPAYSEAGPGASAVPTQPSWSWRTVTNGPAPTGAPSDSPSAPQGLGAPVQASNKHHHQGHGRGY

SEQ ID NO: 2125 - DNA, 2094 bp, Aspergillus niger
cccacctctggacaacgtctttcctcacgatgccccccccctgttatgcgagtggtgcgatccagcttcatccgtacggggctgaaccggcatcttggcagtcgcatccaaagaacctgcggcttcacctcgtcacggtggctatgttgattgaaagtccacctatgaaggtaccaaccaaacccgggagacagtcctggtgcttaaagtgatttaagacttgtcttggaacccaacatgctgccgacccgtctatataaagggagcaggtagagacctgaaccatatcccagaacaagcctctcacatcgtctttcctttctctcatccccaactacctttccattctttctctctcctagttacaatgaccaacttcaagtggatcgttgccgccgccggtctcctgtttggacaggtcctggctgctcctactgccacttctacccatgccaagcgcgcaaccgtcagcgacgtaagcaccctccctgtgaagaaccccacagatattgacattggcaggctgcgttcggctatgctagcctgaacggcggcaccaccggtggtgccggcggtactaccactaccgtctcgtcctacgctgccttcacctccgctgtctccggcgatgacgccaaggtcgtctacgtcgacggcaccatcaagcagaccgccgaccaggtcaagattggcagcaacacctccatcatcggcaaggacgccaacgccatcctcgagggattcggagtgtaagcacgtcccaacaagagggagctgaattaagcttacatgcaacagtctcgtcaaggagaaggagaacgttatcatccgtaacctcggagtctccaaggtccttgctgacaacggcgatgccattggtgtccgtacgtgacacccactcatcctgcacaccctaccagatgctaattcaagcagagtactccaacaacgtctggatcgaccactgcgatgtctcctccgaccgtgaccacgacaaggactactacgacggtctgattgacgtatgccacccaccaccaccatcataccaaaagggtcctcactcactaacaactactagattacccacggctccgactacgtgaccgtctccaacaccttcatccacgaccactggaaggcttccctggtcggccactccgatagcaacgaagacgaggacagcggccacctcaccgtcacctacgccaacaactactggtacaacgtcaactcccgcgctccctctttccgcttcggtaccggccacgtctacaacagctactacctggacgtcagcgacggcatcaacacccgtgacggcgcccagctgctcgtcgagtccaaccagttcgtcgactccaagaaggctctctactccaccgacgatggctacgccgtctccaacgacaacgacttcggtgattctgagaacactgccgaggagggtaccctgacttccatgccttatgactacacccttcttggctccgccaacgttaaggctgctgtcgtcggcactgccggtcagactcttactttctaagcgtgctgtgatgtgcttgggatattagtttagtaggctgaggttgactatgcctttatcattcttttatcttggtatctgcagcacagctatttgagccctagcttgtgaactatcctagggtcgttatttagttattgctcgaattgcatttaattgaggcaacatgattacaattagcgtagatgactgcatatatttcataaatcgcataacgtccatgcacagcataatgcaagccagtgaacatatcggcaaatcctcggcccaactccatccagacgagtactccacatcccacataacccgcctgtccagacccacctattcaaccagcttaatccgtagagtattcctaatcaagtccgcggtagactctggaacttatctacccactaaccgattcataaaagatccatgcatcacacaacagacaaacacacccatagctcatacggacaccaccggattccccatcctcatcgggacttatcccctggagcaccatgttcttccctgcctacatccttactacaactgtaataaaa

SEQ ID NO: 2126 - protein, 323 aa, Aspergillus niger
MTNFKWIVAAAGLLFGQVLAAPTATSTHAKRATVSDAAFGYASLNGGTTGGAGGTTTTVSSYAAFTSAVSGDDAKVVYVDGTIKQTADQVKIGSNTSIIGKDANAILEGFGVLVKEKENVIIRNLGVSKVLADNGDAIGVQYSNNVWIDHCDVSSDRDHDKDYYDGLIDITHGSDYVTVSNTFIHDHWKASLVGHSDSNEDEDSGHLTVTYANNYWYNVNSRAPSFRFGTGHVYNSYYLDVSDGINTRDGAQLLVESNQFVDSKKALYSTDDGYAVSNDNDFGDSENTAEEGTLTSMPYDYTLLGSANVKAAVVGTAGQTLTF

SEQ ID NO: 2127 - DNA, 2207 bp, Mycosphaerella pinodes
ggtacccgtcattgcatgatggaagtatttcgcatgtcgcgatgtccgatgtcccaccagaccatcgtttctccacatcatagattcctgtgcgcaaaggtccgctcaattttacttctacctcttcaagttaccgcggcgtttcgaccataaagcccctggcttggcagcgcgaacagtgcagtctccaccatatacggttagacgtttcaaacgaatccccttcgcatcataccaagcgtcttctgacagtgcttgtccactgcttattctgccatacctagtccaatcaaatggatcgcccgcatcaggatcgcatagcctccgctgtcgtgatcaaaaccggtaatgtctccatcgtacgagaacggttgaaacatggtgacgggattcctggggcatgcttgaacaaagcgtagggcttgaattaatcgggcgagtacatgataagtcgggactcggactcgcatcgggctctgcagtctctatataagaaatggaactctgctaatcactgttccttagctcagctcttccgttcttttccaaccctaccacttcagtccttcgtttcactaaacagtcattctttctcgaactcgccaacacttcgacacaatgaagttcagcacatttgtctccctcggccttacagccatcaccgctctggcagcgcccacacctagcatgatcgatgtcaagcgtgacgtcgttaagcgtgctgcttccctcgaggatgttgccactgtaggttacgctaccaccaacggcggaaccactggaggtaaaggcggaaagaccgttaaggtgtcgtccctcagcgagtttaccgccgccgtcaagggtgacgaggctgccattgttctcatcactggtcctatcaagggctctggcgacaacgtcaaggtcggcagcaacaagtccatcatcggacagaacagcaaggtcgtgcttgagaacttcaccatcaccgtcaagggtgtcaagaatgttatccttcgtaactttgccgtccagaaggtcgtcggtggcgatgctatcgccatccagaaggtatgagctcgtaacgcccaaggaaattaccacatacttacaccgactccagtccgagaacgtttgggtcgatcaccttgatctctcctccgaccgcgaccacgacaaggactactacgatggcctgctcgacatcacccacgccgctgacttcgtcaccgtaaccaacaccttcctgcacgaccactggaaagcatctctgatcggccactccgactccaacggagccgaggacaagggtcacctgactgtcacctacgccaacaactacctgaagaacctgaactcgcgcggccgtccttccgcttcggcacaggccacttctacaacaactactacgagaacgtgtcggatggtatcaacacccgccagggtgcgcagctgcttgttcagaacaacgtttttgtcggctccaagaaggctctttactcgactgatgctggatatgctgttgagtctggcaacgacttcggtgatggcaagaacactgccgagaagggtactttgaccaaggccccttacactgtctctggtcttcttgatgcgagcaaggtcaaggccgcggttgttggtaccgctggtaacacactctctttctaggtggtttgccttaagatgaacgatcatgataagtggttggaagtcaatgagttgcatgtgtgagacgtatgactgaagatcgaaggggtcttttgacaaaacaagccaaaatcctcgacattcttgtagatatttgcgctggtcgtggagatagatgtacaatgtcacggccgctcttctcacaatctatgtcccaatagtgacttcgcacagacgttggcctgaataacaacttgtcctccaagttgccttatggttttgtgacaacatgtgtggtcgtgcagtagatagccatctgtcacttaccgtgagaagaaacgccccatcatttccgtgtagattgacgcccgtaaatggcagctgtggatcgccgctcaccttcaagtaagaaaggcatacggtacgccacagtcgccgcgagagtgggtctcaatcacgtcacaacagatcagatatctcaattacgacacatcagcgatgacctgccagcgcaagaatccaccaggttgtaacatttttgttggcgcgaacgatccgttgacctgcaggtcgac

SEQ ID NO: 2128 - protein, 299 aa, Mycosphaerella pinodes
MKFSTFVSLGLTAITALAAPTPSMIDVKRDVVKRAASLEDVATAERPLRCRPSASLPPPSRVTRLPLFSSLVLSRALATTSRSAATSPSSDRTARSCLRTSPSPSRVSRMLSFVTLPSRRSSVAMLSPSRRYELVTPKEITTYLHRLQSENVWVDHLDLSSDRDHDKDYYDGLLDITHAADFVTVTNTFLHDHWKASLIGHSDSNGAEDKGHLTVTYANNYLKNLNSRGRPSASAQATSTTTTTRTCRMVSTPARVRSCLFRTTFLSAPRRLFTRLMLDMLLSLATTSVMARTLPRRVL

SEQ ID NO: 2129 - DNA, 2568 bp, synthetic construct
gaattcgaatctggaggacattacgtgtgcctgacttcggggtacttctgtcttcactgtagccaggcactatccctgacactctgccccctacgtggtcttacctttatcggatttagatagtaaccaatctgatcccacatcctgatacctggatacttttccccatggcatcgtgtaatctatgatactcaaaggaacaaagcagatacttgaagctgcatagaccttgtctcagagatcgcagctttgttgtttagaaacacagtctgtcaccggttcgccagattaagtgttaaacatgtgacaggcacctaaaagctgacagcctcggcctgagctcgtagagtaccctcttctaggtctttgtgggttgactgcaagcaaaggatcaagcttgtcggagaatttggagcttttgcatgtaatttttccgactggggtccgagtatttcccgcggtgtatgttagaatggttagtatggatagattggtagaaaagttgacctgaaacattgagatatctgattagtagtatgctatagatctggatatacatttctgcaatgaaatgtgatcatatgaactttttgaaatgaaggagatatatgcatagttgtgaaatatgcgcgtggcctgtccgttctcagccctgacgggtgacatcccgttcggctgtttagtggaaagccgcgtggctgtctcgggggagtgggtcagggtcctccaggaattttcttttctaggttagttcttccagccttccagggtcctgcagacccgcctccaaacagctgattgtggtgtaaccgtttacaagactggccagcatatttttgtatatgtcactatcgtgaagattatattcatcttatatcaattggagcttgaggtctatctcttagtgtgcgcacaaaaagccgatatgattcaatgcgtctgtcaaataacccgaactgtccgaatcatcacacccacagagtgctgcgaaggtcgtgatccttccaagtatctcagaaaagaccactacactggacccccaacaaaggtacacaataacttcgggtagagaattgtgcgatgcagagcatagtatatctgaaacaactgtcactgcagacctttcctacttgtgcatccggttcgcattgcagtggggcagggcagttcttggccgaagaactatgatcactttgtaacaacggtggcccctgtagctaccagtgttctgtacttcggcaaaattcaatccttggcttctatatgtcactaggtgactttgaatacataaagatgaaatgttggaactttggacgatacctctgtctgtcaacacaatctgtacttttccaaaacccttatccattatgaaggtccccttcctccaacttctctgcctaaatgccgccttggctagtgccaatgttgttcaaggtgctgcccagggtttcgcagccggcgtcactggcggcggcgatataactcccagctaccccaaaaccaacgaggagcttgtctccctgctcgagagtgacgaaccccaagtcgtcgtactcaccaagacctttgatttcatcggtaccgagggaaccacgaccgaggatggatgcgcgccctggggtactgggaagtcctgccagctggccatcaactccaatggatggtgtggtaaaaatcccgtcgtaaccatcacgtatgataacgccgccaagaatggcattcatatcaagtccaacaagactcttgttggtgagggagacaagggcgtgctcagcggaaagggtctctactttgagggtggtgtttccaatatcatcgtgcagaacattaagattacgaacctcaaccctgggtatgtatcatcccagtaactaggagttctcgaatgctttgggagacacaccatgtgttctaacgtctttcactacagttttgtctggggtggcgacgcgtttactttctttggcgctgacctgatctggatcgaccactgcgaggtaagacagaaatctccatcatctgataatcatgattgagtttctcacgttgacttatggattagacctccctcaccggacgccaacactacgtgaccggcttccaccccaacacccgcatgacttggtccaataacttccttaacggcgtaaccacccactccgcaggctgtgatgaccaccactactggacaatggagctagttggccctggggacgagattaccttccagagtacgtgtcccatgaaaacctaaaagaagcatctattcaactaacatacgtgttcactcacagacaactacgtctaccacaccaccggccgtggacccgctctctccggtaaaacagattacatctagcttgaaaatcatccctctctggttcaagtattcacgtcagtagctgaaaagggaataacgatgaccgcgaataatttgacaatcatctacccgatgaataccaatcaaggaaaacaaaagtcgtgagaaaaatgcaagggagaaagttatatgttacaaaagaaacatacaacagaaggaatatgtcagtggtcattgaacattacaaa

SEQ ID NO: 2130 - protein, 256 aa, synthetic construct
MKVPFLQLLCLNAALASANVVQGAAQGFAAGVTGGGDITPSYPKTNEELVSLLESDEPQVVVLTKTFDFIGTEGTTTEDGCAPWGTGKSCQLAINSNGWCGKNPVVTITYDNAAKNGIHIKSNKTLVGEGDKGVLSGKGLYFEGGVSNIIVQNIKITNLNPGFVWGGDAFTFFGADLIWIDHCETSLTGRQHYVTGFHPNTRMTWSNNFLNGVTTHSAGCDDHHYWTMELVGPGDEITFQNNYVYHTTGRGPALSG

SEQ ID NO: 2131 - DNA, 2774 bp, synthetic construct
ctcgagtccagtagttagtagttgcggataacaaggatagatcatcccctttggttatgtgtgagtctgaccaaggaagcattgggggagagactattgggtcaatggcactcacgggaaaaagaggcgaaagggatgggagaggtgatgcctgaggccgcatgaatatatcatgtgagagcaaagaagatcaaacaaacaatacaaaccccagcgtgacccctcactgccacgtgatttcccagctaatcctcttcggggtgttttcccccccaatcggggcttcttggcaaccactaatttccataatttccactggactcttgaacggttcttgcaatgtctcactgtcagactgagagtaccacttttctccctctaccaagccttgaaataggtcagggccgttcatgggaccctgacctccaccccttcggaagccagccggattgcttctaagacatcctgaagtgggccaccatccggctctcaccattcctatgctctgccaagcgactcgacctcgttcttcaccggagtgcccgggtccgccctgaactcaaggtctgcatgggaagagatttccggctgtttcccccaacggcgtctaggcagataggctaggcgttgtgttcctggcttgatcagcaaggtttatcatagtcctcatgactcgtaaaacccaagaagataaaatgaagatgttgggtccgcgagtccggtgatgtctgggcagcagtagtaacactctaaaatataagccaccacacccactgacaggttaatctccggtagaagaaccaagacctacctgccaagccacgttgattgggttctcatccatttcaggtcctgtccccggtcccctggtgtcattccagaacatggtcaaggaaatcaaacggccactgtctgactgccagctccaccatcatgtaatccggcttctctatataaacttgggaatgttcccctctcctgtgccacccagaagaagacatcaccttccttgcttctacaagcctgtcactctttccaggccgtcgttctttgatatttctcactagactttcattctcttgaatattttctttttgttttccctcgtattttctgtgctttgagagcccaacatgcattacaaactgctttttgctgctgccgcagcatccttggccagcgctgtcagtgccgccggtgttgttggtgccgccgagggtttcgcccatggtgtcactggcggtggcagcgcttcccccgtctatcctacgactactgatgagctggtctcttacctcggagataacgagccccgggtgattatcctggatagaacgtaggtcgatcctcaattggaaatggatgggtagacgtgggcctaacaggttgataatccagcttcgacttcaccggcactgagggtactgaaactaccaccggatgtgccccctggggaactgcttcccaatgccaggtggccatcaacctgcacagctggtgtgacaactaccaggctagcgcccccaaggtatccgtgacttagtatgttgtccccgttcgattggtgaccctgtctttccatgctgatagccgtatagtgataaggcgggtatcctccccattacggtcaactccaacaaaagtatcgttggtcagggcaccaagggagtcatcaagggcaagggtctccgtgtggtcagcggtgccaagaacgtcatcatccagtgagtgcagaacatcggtcttaggatgtgaaaaaaccctttgctaataaaggccaggaacattgccgttaccgacatcaaccccaagtatgtctggggtggtgatgccattactgtcgatgactctgatctggtctggatcgaccatgtgaccactgctcgcattggtcgccagcacatcgttctgggaaccagcgccgacaaccgcgtcaccatctcctactccctcatcgatggtcgctccgactactctgccacctgcaacggccaccactactggggcgtgtacctggacggcagcaacgacatggtcacccttaagggcaactacttctacaacctgagcggccgcatgcccaaggttcagggtaacactctgctgcacgccgtatgtcgccttgagcctcctatatgatttgcacattactgacaagtctgactacaggtgaacaacctcttccacaactttgacggccacgccttcgaaatcggcactggtggctacgtcctggccgagggtaacgtcttccaggacgttaacattgtggtggagacgcccatcagcggccagctcttcagctcccccgacgccaacaccaaccagcagtgcgcctccgtcttcggtcgttcctgccagctcaacgccttcggcaactccggctcgatgtccggatcggacaccagcatcatcagcaagttcgctggcaagaccattgctgcggctcaccccccgggtaacattgcccagtggaccatgaagaacgctggccagggcaaataaggttttacagcagaacaattctgtgaaggaggctggccaaagcccagatgaggatagagggtacctgcttcgacatctatagttcaatagtccaggattatagacgaatgattattgctccagaatggtgaagtatttctagcagaccatgacgcgtacgcaacatagaccgctccatgttactgactgcgactgtatttggaggattgaggaaaggtagataaaagtatatactacaaaaccgccataacagcaaccgacgcctcgag

SEQ ID NO: 2132 - protein, 378 aa, synthetic construct
MHYKLLFAAAAASLASAVSAAGVVGAAEGFAHGVTGGGSASPVYPTTTDELVSYLGDNEPRVIILDRTFDFTGTEGTETTTGCAPWGTASQCQVAINLHSWCDNYQASAPKVSVTDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGHHYWGVYLDGSNDMVTLKGNYFYNLSGRMPKVQGNTLLHAVNNLFHNFDGHAFEIGTGGYVLAEGNVFQDVNIVVETPISGQLFSSPDANTNQQCASVFGRSCQLNAFGNSGSMSGSDTSIISKFAGKTIAAAHPPGNIAQWTMKNAGQGK

SEQ ID NO: 2133 - DNA, 2774 bp, ASPERGILLUS NIGER; identical to SEQ ID NO: 2131

SEQ ID NO: 2134 - protein, 378 aa, Aspergillus niger; identical to SEQ ID NO: 2132

SEQ ID NO: 2135 - DNA, 3160 bp, Aspergillus niger
cagctggaccggaaatatgattgataggggcaacgtcactccatctcccctgattcgtgataaaaatgagttatgattgatgcctacggagtccgagatactcccaccttatcgtgaccagtcacccgttcagactggatgacaaaatcatcagtcaaccaactagatcggtgctaaaaatggacggctaaatttctgcactggattcgaaactcgaggagcaatagctgcccggaggtcgacttgatgggtggtgtcctgatatcgccgaagcccgaaggttccactgtgggccacttgaccggcgttcctggcgccttaccaagaacgcctaattcgtggcttttttcttttcttttttttttctttactttgcgcagcttttccagctgctctcatttgactagaagaccgactggagatatagagaggcgtggggagatactggatccattaataatcgaaacggaaacggtctcaggtggaggctaaacctttcaaagaagctggattcgtgatgcaaaattgtttcccccccggttcccctcttgttcttcaccactgatgaacagccctaactgtcgagcacgtccagccttccatccgtaacatcctcaaactactagctacaccctgatggtcggattcggtattttcccgactatcattgccacaaggactctgccaagacggaggaattgcttctttacagaatttcaatcgcgaggtccaccagcccgagtggatggactagttactttagactaccgtgactaagtcgccggcgcgggcatcatgaaacgccgtaaatcccccgactccctcctaagatccacctatgaccttcaacagcctgcaagacagtgggctgtccagctcagtgtccacgaacaggggccatcaccgtgatggacaaccatgtggctacgactcctccctcccccttccaatcttggttgtcatcgatgcctatcactccatccatggtccgatacgatggacccccttcaatctacttgctcggccagtaccgactttagcgccggtggactgaccgagaagaatcaacggttttgctcaatcgcccttggctactaatcaaagatgcacttggccgtttcataccgatcacccgtccaatttacccagaatggtctgagccagaggggaagctctatcagattcttgtcaaatgcttccgtcaacgagtcagtcttccctataaaaggccccaatcccatccgtattgacctcttctctgtatcaaaccattccttccttttctttccttttctcttcatacctctatcttcaccttagtctttctttccccttcatagctggttctacacacttcaccatgaagtactctactatcttcagcgctgctgccgctgttttcgctggttccgccgctgcagtcggcgtgtccggctctgctgagggtttcgccgagggcgtcaccggtggcggtgatgccacccccgtctaccccgacactatcgatgagctggtctcttaccttggagacgatgaggcccgcgtcattgtcctgaccaagaccttcgacttcaccgacagcgaaggtaccaccactggcactggttgcgctccctggggtaccgcttccgcctgccaggttgctattgaccaggacgactggtgcgagaactacgagcccgatgctccctctgtcagcgttgaatagtatgtccttggggattgtcacccgcttcgatcttgtatctaacttggatagctacaacgctggtgtcctcggtatcaccgtcacctccaacaagtccctcatcggtgagggctcctctggtgcaatcaagggcaagggtctccgtattgtcagcggtgctgagaacatcatcatccagtaggttatgctcggtgtcattaggaatttgctctctaacgaaatcaggaacatcgcggttaccgacatcaaccccaagtacgtctggggtggtgatgctattactcttgatgactgcgacctggtctggatcgaccatgttactgtacgtcttcatcttattcaactactacattatatttcaagagcattgagttaacatatgacagaccgcccgcatcggtcgccagcactacgtccttggaaccagcgccgacaaccgcgtctctctcaccaacaactacattgacggtgtctccgactactccgccacctgcgatggctaccactactggggcatctacctcgatggtgacgccgacttggtcaccatgaagggcaactacatctaccacacctccggccgtagccccaaggtccaggacaacactctcctccactgtgtaagttgccttttctctgctggccgcttccgacctgactaatcattgttgcaggtcaacaactacttctacgacatctccggccacgcttttgagatcggtgagggtggctacgtcctggctgagggcaacgttttccagaacgtcgacaccgtccttgagacctacgagggcgcggccttcaccgtcccctccaccaccgccggtgaagtctgctccacctaccttggccgtgactgtgtcatcaacggcttcggctgctccggcactttctccgaggacagcacctctttcctctccgacttcgagggcaagaacattgcctctgcttccgcttacacctctgttgcctctcgcgttgttgctaacgccggtcagggcaacctgtaaatgagttgactcatttatggtagatagcagtggatgtaatctaggggatgcggcgtgcttgagaagttacctttcttgtatctacttctataataaattatggggagtgttcacgaccctaatctggttgaataaccagccgacacaatgacattattgtctacagagttttcaagtagatatgttcctttcacatgtagtaaggagtatacagtgttaacaattgataagatggcgatcgtgaaccaaactttcccacccgatgtcccaagataggactaaaagtctaatctggatagccgagccggctatacttcacactcccaaaaagtcttttattagtagaggcatcatcctggaatcgaatattctttgccattcaaactaagttccaggattttgaccctttcctctctgaagccagcaaagtagcaaagcaact

SEQ ID NO: 2136 - protein, 379 aa, Aspergillus niger
MKYSTIFSAAAAVFAGSAAAVGVSGSAEGFAEGVTGGGDATPVYPDTIDELVSYLGDDEARVIVLTKTFDFTDSEGTTTGTGCAPWGTASACQVAIDQDDWCENYEPDAPSVSVEYYNAGVLGITVTSNKSLIGEGSSGAIKGKGLRIVSGAENIIIQNIAVTDINPKYVWGGDAITLDDCDLVWIDHVTTARIGRQHYVLGTSADNRVSLTNNYIDGVSDYSATCDGYHYWGIYLDGDADLVTMKGNYIYHTSGRSPKVQDNTLLHCVNNYFYDISGHAFEIGEGGYVLAEGNVFQNVDTVLETYEGAAFTVPSTTAGEVCSTYLGRDCVINGFGCSGTFSEDSTSFLSDFEGKNIASASAYTSVASRVVANAGQGNL

SEQ ID NO: 2137 - DNA, 1140 bp, Emericella nidulans
atgaggcttcacgcacccattctgtctcttttggctgccgctgccagcaccagcgccgccggggtgacaggatcagccgagggcttcgcaaagggcgtgactggaggtgggagtgcgacgccggtttatccaagcactactgcagagctagtctcgtacctgggagacagttcggcccgcgttattgtcttgaccaagacgttcgacttcacgggaaccgagggtactacgacagagactggctgcgccccctggggcactgcgtcggcctgccaagtggccatcaacaagaacgactggtgtacaaactaccagcctaacgctccgtcggtttctgtaacctatgacaacgccggcgtgttgggtatcactgtcaaatccaacaaaagcctcgtgggtgaaggatccagtggtgtgatcaaaggcaagggtcttcgaattgtcagcggcgcaagcaatgtcatcatccaaaacatcgctatcacggacctgaaccctaagtatgtctggggcggtgatgcaatcaccctcgacaatgcggatatggtttggatcgaccatgtcacgactgcacgcattgggcgacaacatcttgtcctggggacatctgcctctaacagagtaaccgtttccaattcgtacttcaacggcgtgacctcctactccgccacctgcgatggctaccactactggggcatttacttgactggttcgaacgacatggtcactctgaaggggaactatatctaccacatgagcggtcgcagccctaaagtcggcgggaacactcttctgcatgcggtcaacaactactggtatgactcgtccggccatgcctttgaaattgactctggtggctatgtgcttgcagaaggcaacgtcttccagaatatccctactgttattgaagggaccgtcggcggccagctgttcacctccccagattccagcactaatgcaatctgctcgacatacctgggccacacctgccaggtcaatggcttcgggagctctggaacgttcaagcaggcagacacggcgttcttagtgaatttccagggcaagaacattgcgtctgcatctgcgtataccgttgcgcagagtagtgttccgtccaatgctgggcaggggaaactgtga

SEQ ID NO: 2138 - protein, 379 aa, Emericella nidulans
MRLHAPILSLLAAAASTSAAGVTGSAEGFAKGVTGGGSATPVYPSTTAELVSYLGDSSARVIVLTKTFDFTGTEGTTTETGCAPWGTASACQVAINKNDWCTNYQPNAPSVSVTYDNAGVLGITVKSNKSLVGEGSSGVIKGKGLRIVSGASNVIIQNIAITDLNPKYVWGGDAITLDNADMVWIDHVTTARIGRQHLVLGTSASNRVTVSNSYFNGVTSYSATCDGYHYWGIYLTGSNDMVTLKGNYIYHMSGRSPKVGGNTLLHAVNNYWYDSSGHAFEIDSGGYVLAEGNVFQNIPTVIEGTVGGQLFTSPDSSTNAICSTYLGHTCQVNGFGSSGTFKQADTAFLVNFQGKNIASASAYTVAQSSVPSNAGQGKL

SEQ ID NO: 2139 - DNA, 1140 bp, Emericella nidulans
atgaagaccactttcctcgtttccctggccaccgctgccctcagcagcaccgccgccgccgtctccgtcagcggctcggccgagggtttcgccaagggtgtgaccggcggtggtagtgccacagccgtctacccagacaccatcgacgagctggtctcgtacctgggagacgacgaggcccgcgtcattgtcctctctaagaccttcgacttcaccgacagtgaaggcacgaccaccgaaaccggttgcgcaccttggggcaccgacgcggcgtgccaggtcgcgattaaccagaatgactggtgcacaaactaccagcctgacgctccctccgtctcggtgacctacgacaatgccggaaccctcggtatcaccgttaactcggacaaaacgcttatcggcgagggctccgccggtgtgatcaagggcaagggtctgcgccttgttagcggaaccagcaatgtcatcatccaaaacatcgccattactgatatcaaccccaagtacgtctggggaggtgacgccatcactctgaacgacgtggatatggtctggatcgaccacgttactaccgctcgcattgctcgtcagcacatcgtcctcggcaccgaagccgacaaccgcgtgaccatctccaactcgttcatcaacggtgaatccgactactcggccacttgcgatggttaccactactggggtatctacctcgacggctccagcgacatggtcaccatgaagggcaactacatctaccacaccagcggtcgtagtcccaaggtccagggtaacactctgctgcacgctgtcaacaactactggcacgacaactctgatcacgccttcgagatcggtgagggtgcctacgtgctcgctgaaggaaacgttttccagaacatccccaccgtggccgaggaccccattgagggtgagctcttcgcttctccctccgaatctgccaacgaggtttgctcgacttaccttggccgtgtttgcgagctcaacgggttcggcagctctggcaccttcaaccaggccgacaccgatttcctcagcaagttcgagggcaagaacatcgcatccgccgactcctacagcagcgtcgcttctagtgtcgcctcttctgccggtaacaccctttaa

SEQ ID NO: 2140 - protein, 379 aa, Emericella nidulans
MKTTFLVSLATAALSSTAAAVSVSGSAEGFAKGVTGGGSATAVYPDTIDELVSYLGDDEARVIVLSKTFDFTDSEGTTTETGCAPWGTDAACQVAINQNDWCTNYQPDAPSVSVTYDNAGTLGITVNSDKTLIGEGSAGVIKGKGLRLVSGTSNVIIQNIAITDINPKYVWGGDAITLNDVDMVWIDHVTTARIARQHIVLGTEADNRVTISNSFINGESDYSATCDGYHYWGIYLDGSSDMVTMKGNYIYHTSGRSPKVQGNTLLHAVNNYWHDNSDHAFEIGEGAYVLAEGNVFQNIPTVAEDPIEGELFASPSESANEVCSTYLGRVCELNGFGSSGTFNQADTDFLSKFEGKNIASADSYSSVASSVASSAGNTL

SEQ ID NO: 2141 - DNA, 4454 bp, Erwinia chrysanthemi
cagaccgcataagcggactataaaggaaagaattgaaagaaaggatttcgacaaggtgccggcaccttattaatagaaggaatcagaggaagtcagcacgtttcggcgagaaggtgtcgatcaacacgctgccttcttccagcgatactacaccgtgcatttcattcttcaccgccatataggcatcgccggttttcagaatgcgtttttcgccttcgatcaccacttcgaagctaccggccgccacataggcgatctgatcgtggatatcgtgcttgtgcggcgtaccgatggcacccttggcgaaatgaacgcacaccatcatcaaatcatcgctccaggtgatgattttacgcttaatgccatcgcccagctcttcccacggcgtttcatcgtcaataaagtaccttctcatggtttctccttaagatcatataacgtgcctcccttgtgtgaacaaggtaacacaaagggtagataccgatattctagtaacatcggcattagatgaaacataaaataagcaaaaccatgacgcctctcaagaaataaataaaacattatttcatttttattgaattcacatctcaaccacactatcatcgcgccataacacgaaagaaccgggcaaaaaaggttcaggtgacgttgtcactgccacgcaaggtgacctgttccgcccggcgctttcctgtcagggtcacagcctgatttctatctgaaagcgaggagcaaccatgcaagtccgtcagagcatccatagcgaccacgcccgtcagcttgataccgctggcctgcggcgcgagtttctgatcgaacacatttttgatgcagacgcctgcaccatgacctatagccacatcgatcgaatcatcgtgggcggggtaatgcccgttcatcaggcggtgactgtcggcgaggatgatggaaaacagctgggcgtcacgtactttcttgaacgccgcgaactgggcgcaatcaatatcggcggcgccggcgtagtcagtgtagacggcgaacgctatgcaatcggtcacgaagaagccatttatatcggcaaaggcgcgcgggatatccgttttaccagcgtagacccggccaaacctgcccgtttctactataacagcgcgccggcgcacaccacctttccgacacgcaagattaccgctgcagaagcctccccgcagacaatcggtgatgacgcgaccagcaatcgtcggaccatcaacaagtatatcgttccggatgtgttgcccacctgccagctcaccatggggttaaccaagctggcggaaggcaatctctggaacaccatgccgtgccatacccatgagcgccgcatggaagtctatttttatttcgatatggatgaagaaacggcggtgttccacatgatgggacagccacaggaaacccgccacattctggtgcacaacgagcaggcggtgatttcaccgagctggtcgattcattcaggtgtaggcaccaaacgctacacctttatctggggtatggttggcgagaatcaggttttctcagacatggatcacgtcaaagttagcgaactacgctagcggcttacccaataatttcgcgttgcgggaaagtggcaaatgagcgcgtccccggtcagtcatcgggatgagtgacagcagccagcaagccggcaacctgaaatatgacgggtataaaccggtatttccctacagtaacaagctcacgacaaaacatgtcgtttacagagagattaaagctatgattctgaatacattcaatttacagggcaaagtggcactgatcaccggttgcgataccggcctgggtcagggtatggcggtcggtctggctgaagcgggctgcgacatcgtcggcgtcaacatcgttgagccgaaagaaaccatcgaaaaagtcactgcggtaggccgtcgcttcctcagcctgaccgctgatatgagcgatatctccggtcacgccgcgctggtggaaaaagccgttgccgagttcggtaaagtggacattctggtcaacaacgccggtatcatccgtcgtgaagacgccatcgagttcagcgaaaagaactgggacgatgtgatgaacctgaacatcaagagtgtgttcttcatgtcgcagacggttgctcgtcagttcatcaagcagggtcatggcggtaaaattattaatatcgcgtccatgttgtccttccagggcggtatcccggtaccgtcttacaccgcatccaagaagcgcgtcatgggcatcacccgtattgtggccaatgaatgggcgaaacataacatcaacgtcaacgccatcgctcccggctacatggcgaccaacaacacccagcacgtgcgcgccgatcaggaccgtagcaaggaaattctggaccgtatcccagcgggtcgttggggtctgccgcaggacttgcagggtccggccgtgttcctggcatccagcgcatccgattatgtgaacggttacaccattgccgttgatggcggctggttggctcgctaattttccgcaaaatttttttgtgatcgaaggcacaatactgaattgtgcctttcttttatctatcaataatttatcatcaacccgcctttcctcttcgtttccaaatcttccataaaaaattttcaaaacaacgttccgactttgatcacactttcgatattgagcgcatgacgaaaatagaagttgggcaatataatcaatcaaaacaatgtttctatttataaggaactgtttcgctcagttctgaaagaaggtactccatgagtatttttactgatttgaacaccagcagaaaatggcaaatcgaccagtggctctcggcggttaacagccatattgaaaagattcagcaatacggccacagcgtagtcaacccaacgccgttattggctgacggatttgagataaaaacacagtctccagttgtctggcagtttcccgatggtcatgatgctccgatttctaacttcgccagccagcaaaactggctgcggttattaatttccatgagcgtcatcacagaaacggaaaaatatcgtcatctggcattctgtcagagcgaatattttctgaatcgctttgtcgatgaaaatagcgggcttttttattggggcggccatcgttttattaatctcgatacgctggcaagcgaaggcccggaatccaaatcaatggtgcatgaattaaaacaccatctgccctattacgaatttctgcatcaggtcaacccggaaaaaacccgccatttcattcagggattctggaatgctcacgtcgaagactggagctgcctggatctgggccgccatggtgattacgccagacaacgcgatccggacgtgtttctgcattcccgccatgatgtggtcacccctgccaactggccggagttaccgctgaccaaagggctgaccttcgtcaatgccggcaccgacctgatctatgccgcctttgtctacgcacgccacaccggcgacgcgcacgcggcggcctggggcaagcacctctatcgtcaatatgtgctggcgcgtaacccggaaaccggtatgccggtttaccagtttagctctcctttgcaacgccagccggtgccggcggacgacaaccagacccaatcctggtttggcgaccgcgcccagcggcaatttgggccggagtttggcgccattgcccgtgaagccaacgtgctgtttcgcgacatgcgcccgctgctgatcgataacccactggccatgctcgatattctgcgccatcaacccgatgcggaaatcctgacatgggtgatcgccggcctgaaaaactactatcaatacgcttacgacgttaacagcaatagcctgcgcccgatgtggaataacggtcaggacatgaccgactactgcttcaaacgcgacggctactacggcaaagccggcaccgtactgaagcccttcccgctggaaggcgactacctgctgccgctggtacgtgcctggctcctgagcgacgatgacgacctgcacacactgatcgtcaccatgctgtcccgactggagaaacagggcatccaccaatccgcttcgccgttcctgctgctggcgattaccgaactggcgcatgccaaacagtcggcgcagtgggcggaatatgcctggcaaatggcggaaattttatttaagcgctatttccatcacggtttattcgtacgttctgaacatcatcgttatgtgcggcttgatgatcccttcccagccattctgctgacgctgatcgctgcctgcagaaataaatggtcggaagttcctgcggtcctgacacaagggggatacatccatggagattatcgaattaatggagaaagccgggttatttacgacacgggaatttatttacccagaaaaattaatccactgattttatttttacagattcaccattactaaaagtaggtaggcatt

SEQ ID NO: 2142 - protein, 110 aa, Erwinia chrysanthemi
MRRYFIDDETPWEELGDGIKRKIITWSDDLMMVCVHFAKGAIGTPHKHDIHDQIAYVAAGSFEVVIEGEKRILKTGDAYMAVKNEMHGVVSLEEGSVLIDTFSPKRADFL

SEQ ID NO: 2143 - protein, 278 aa, Erwinia chrysanthemi
MQVRQSIHSDHARQLDTAGLRREFLIEHIFDADACTMTYSHIDRIIVGGVMPVHQAVTVGEDDGKQLGVTYFLERRELGAINIGGAGVVSVDGERYAIGHEEAIYIGKGARDIRFTSVDPAKPARFYYNSAPAHTTFPTRKITAAEASPQTIGDDATSNRRTINKYIVPDVLPTCQLTMGLTKLAEGNLWNTMPCHTHERRMEVYFYFDMDEETAVFHMMGQPQETRHILVHNEQAVISPSWSIHSGVGTKRYTFIWGMVGENQVFSDMDHVKVSELR

SEQ ID NO: 2144 - protein, 253 aa, Erwinia chrysanthemi
MILNTFNLQGKVALITGCDTGLGQGMAVGLAEAGCDIVGVNIVEPKETIEKVTAVGRRFLSLTADMSDISGHAALVEKAVAEFGKVDILVNNAGIIRREDAIEFSEKNWDDVMNLNIKSVFFMSQTVARQFIKQGHGGKIINIASMLSFQGGIPVPSYTASKKRVMGITRIVANEWAKHNINVNAIAPGYMATNNTQHVRADQDRSKEILDRIPAGRWGLPQDLQGPAVFLASSASDYVNGYTIAVDGGWLAR

SEQ ID NO: 2145 - protein, 553 aa, Erwinia chrysanthemi
MSIFTDLNTSRKWQIDQWLSAVNSHIEKIQQYGHSVVNPTPLLADGFEIKTQSPVVWQFPDGHDAPISNFASQQNWLRLLISMSVITETEKYRHLAFCQSEYFLNRFVDENSGLFYWGGHRFINLDTLASEGPESKSMVHELKHHLPYYEFLHQVNPEKTRHFIQGFWNAHVEDWSCLDLGRHGDYARQRDPDVFLHSRHDVVTPANWPELPLTKGLTFVNAGTDLIYAAFVYARHTGDAHAAAWGKHLYRQYVLARNPETGMPVYQFSSPLQRQPVPADDNQTQSWFGDRAQRQFGPEFGAIAREANVLFRDMRPLLIDNPLAMLDILRHQPDAEILTWVIAGLKNYYQYAYDVNSNSLRPMWNNGQDMTDYCFKRDGYYGKAGTVLKPFPLEGDYLLPLVRAWLLSDDDDLHTLIVTMLSRLEKQGIHQSASPFLLLAITELAHAKQSAQWAEYAWQMAEILFKRYFHHGLFVRSEHHRYVRLDDPFPAILLTLIAACRNKWSEVPAVLTQGGYIHGDYRINGESRVIYDTGIYLPRKINPLILFLQIHHY

SEQ ID NO: 2146 - DNA, 1385 bp, ERWINIA SP. BTC105
tatgcgtgcgattcggttttacttatctatcccctaaatattcgggttgcgggcagacggcaaccggcaaaccccagcgacagaagcaagtaactggggcaagcgagggtcgtcggcgcgttcgtaacctgaaacatgaccgggatacccctgccgcaccaacctataaagggcatgtggaacgataaatgcccatctcacatttttcaaaaacaggaatactactcatgaaatcattcattgccccgattgccgccggtctgctgctggcctttagtcaatccagtctggctgcgacgggcggttatgccaccacttccgggggcaacgtgacaggaaccgtcagcaaaaccgcagcatccatgcaggacatcatcgatatcatcgatgccgccaaactcgacgccaaaggcaaaaaggtgaaaggcggcgcgtacccgctggtcatcacctataccggtaacgaagattcgctgatcaacgccgctgccgccaatatctgcggccagtggagcaaagacgcccgcggcgtggaaatcaaagacttcaccaaaggcatcaccatcatcggcgccaacggttcttccgccaacttcggcatctggatcgtgaactcctccgacgtagtagtacgcaacatgcgtatcggctacctgccgggcggcgctcaggatggcgatatgttccgtatcgacaactcgccgaacatctggctggaccacaacgaactgtttgccgccaaccacgagtgtgatggcaccaaagacggcgacaccacgttcgaatccgcctttgacatcaagaaaggcgccacttacgtcaccatttcctacaactacatccacggcgtgaagaaagtcggtctggcagggttcagcgcctctgacagcgccgaacgcaacatcacttaccaccacaatatctacaatgacgtcaacgcccgtctgccgttgcagcgcggcggtaacgtacacgcctacaacaacctgtacaccaacatcaccagctctggtctgaacgtgcgtcagaacggcaaggcgttggtcgaaagcaactggttcgaaaacgcggtgaacccggtgacgtcccgctacgacggcagcaatttcggcacctgggtgctgaaaaacaacaacatcaccaaaccggctgatttcgctacctacaacatcacctggacggcggataccaaagcttacgtcaacgccgatagctggacttccaccggcacttacccgactgtgacctacagctacagcccggtcagcgcacagtgcgtgaaggacaaactggctaactacgctggtgtcggtaaaaacctggccgagctgaccagctcagcttgtaaataatcggttcccatcagccacgctgatgcctggaac

SEQ ID NO: 2147 - protein, 374 aa, ERWINIA SP. BTC105
MKSFIAPIAAGLLLAFSQSSLAATGGYATTSGGNVTGTVSKTAASMQDIIDIIDAAKLDAKGKKVKGGAYPLVITYTGNEDSLINAAAANICGQWSKDARGVEIKDFTKGITIIGANGSSANFGIWIVNSSDVVVRNMRIGYLPGGAQDGDMFRIDNSPNIWLDHNELFAANHECDGTKDGDTTFESAFDIKKGATYVTISYNYIHGVKKVGLAGFSASDSAERNITYHHNIYNDVNARLPLQRGGNVHAYNNLYTNITSSGLNVRQNGKALVESNWFENAVNPVTSRYDGSNFGTWVLKNNNITKPADFATYNITWTADTKAYVNADSWTSTGTYPTVTYSYSPVSAQCVKDKLANYAGVGKNLAELTSSACK

SEQ ID NO: 2148 - DNA, 2316 bp, Erwinia chrysanthemi
gtcgacattgcattgatagcctttattttcacttctgatgcaattcagcttttttaacgaattgattttcagcaccattgcgtcattaaaaagcgtaccgactttttgtttcatttcctgattggtttgcgccaccatctcgtcaactgcttgcccgatatcctgctcggtcggctcgcggccgccacatcctgataacaccacggcaaccaacgcacaaaaagcagccttatttatcatcatcacagacatccctattaaaaacgtgcataaacccctataaatgcttattcagcagcaaagcggcgtatctgaatatacctgtcgtttttcgcgcggcggacacgttgccatcctttgcggccagtgtggtcgcaccgtataccgtcaaaatgcgaagaaccgcgctcaagcggtatttcgacaggttctcttttatccggcgattggccttcgccagccgatgcaataaccgatatctgccggtcaaaccatcaaaaataaacaaatcattcacattatgattaccactgaataaactgcacgacggtattatcataaagctgctcaaacacatagctattctctcccctgctcttgcaatggaacaaaaatcaatcagataacgataaaaaacagatctttgtcacattcatttttacagtattacggatatttcataaataaaaatgacataactctcttttcaaaattagaaaataaaataaatgacattcacatcaggttaattttcgaaacagcggtttatttttctcgccctttttattttttgttctatagtaagctcgatacattcaggaagtacccgcttttatttatttctctcaactgaatgagagtcaatacctgtgggatttacaaggagattgtatgtttaagtatgtaatacctctgtgtgcactcactctggcggcaccttcattcgccgcccaaaccacactgatgctttctcagaaaagcgatgtgaattatctgggctggtctaccgacgaaagtaaagtggcgcgtcaggaagtttatcgcggcactaccagcaaccctgacctgcgtgaacgtatcgccgtgctggacgcggaaacccgtacctttaaagatgccgacaccaatagcggcctcaattactggtactgggtggacgtcgtcagcgaaaatcaggctcaggtcgtatcaaatgccgtcaccaccgcaccgaacgccggcccgctgcgcgcagcgaaagccagttccgagtgtaagccgggcgccacgttcgaaaaccggacggtggattgcggcggcgtgaccatcggcacctcctgtccgaatgacagcgacaagcagaaaccgctgatcattctgaaaaacgctacggtgaaaaacctgcgtatttccgcctccggccgcgcggacggcatccactgcgacagcggtaactgcaccattgaaaacgtgatctgggaagacatctgcgaagatgccgcaaccaataacggtaaaaccatgaccatcgtcggcgggatcgcgcataacgccaaagacggttatggcggcaaaccggacaaagtgctgcagcacaattccaaaaacagcaccaccgtggtgaagggcaacttcaccctgaccggtgaacacgggaaattgtggcgttcctgcggcgactgctccaacaacggcggcccgcgtttcctgaccgttaccagcgccaccgtcaacggcaccattgacagcattgccggcgtcaaccgcaactacggcgacgtggcgactatcagtggtctgaaaatcaagaattacaaagaaggcaaaccgccggtttgcgaagagttcaaaggcgtagtaaaaggccagggctcaacggaaaaatacggcgaaaaatgggacaccaccaactgtaaggttagccgttcaggcgtcagcaaactctgacagggtcgtctgaccggttgaaacacaacacgggcttcctggcgtatcaaccagacaagaccgggctacgcgcccggtctttttatttcccggcaacgccggttacgccgccacgctggtcgccagcgtctccacccggtgtatcgcctgacgcacccgctgctccgttacggtaaacggcatattcgccatatccggcgcatcaaccgatgcacgaacgatcgccgtcagttccgcctctgacagatccgggcagatcgccgccagcgtcagcggcactgcacaagcctgagccagccgaatcgccgccagcagctcttcatcactacgctgctccagcgccagcaggcacagattgccgaaaccaaccagcaggccgtgaccgaattc

SEQ ID NO: 2149 - protein, 344 aa, Erwinia chrysanthemi
MFKYVIPLCALTLAAPSFAAQTTLMLSQKSDVNYLGWSTDESKVARQEVYRGTTSNPDLRERIAVLDAETRTFKDADTNSGLNYWYWVDVVSENQAQVVSNAVTTAPNAGPLRAAKASSECKPGATFENRTVDCGGVTIGTSCPNDSDKQKPLIILKNATVKNLRISASGRADGIHCDSGNCTIENVIWEDICEDAATNNGKTMTIVGGIAHNAKDGYGGKPDKVLQHNSKNSTTVVKGNFTLTGEHGKLWRSCGDCSNNGGPRFLTVTSATVNGTIDSIAGVNRNYGDVATISGLKIKNYKEGKPPVCEEFKGVVKGQGSTEKYGEKWDTTNCKVSRSGVSKL

SEQ ID NO: 2150 - DNA, 7480 bp, Erwinia carotovora
cccgggggatctcaaagcaatcgggtagcgatgctgaatcaataatgagcgaatgatagcgggtgaccgtcaaaggctgagctagccctgcgaaaacccccgtttcgctgtgcgcaatctcagaggttttcccgtgcatgacctgccgtgctcgcaccacacgcgcgccgaacgcctgtcccatcgcctgatggccaagacacacgcccagaataggcagtttatcggcaaagtgacggatagcagccagtgaaatgcccgcctcatccggcgtacaagggccaggtgaattaaccaatcgctcaggggcaagccgttcaatctcgcgcagcgtcagttcatcattacgcttcaccacgacctgtgcgccaagctcgcaaaagtattggtaaaggttgtaggtaaaggagtcgtagttatcgataattagcagcatagtcattgcactgttagtcggaaaagccgtactaacatacatgaaatccgcgtcaggtacccacccctcgtcaccatcaaagacaaaggtggcgatctcgctgtttaagaaattagcatggtaataattttatcgatcataaatcatttatttcatcagtaaacatctttattaataggccttatttattatcccaattcacagtaaacgattaccttgaaattatttttaacaaaaaaaataataagaaaaaaccgcctatgaattaattcattttttttaaaaggaagaaaaactaaagggatcatttcttacgtgatattttttggtggcgatcacaatcgttcaacaagcgaataaccacgcatataaacgggataaaaaataaagaacccttaaaaacataaagacatgaatttaaatgatttaaatagaaattggtttctatttgaaatagatagacacaaatcctctcaactgtcctctgttatttaattaatatatttaacgccccatcctgtattgtttgtttttctggtaacacttatctcggctttatagacaaaccttattttcatttttgttgaaacagcctttttaaattacacagggtgtgtagtgataaatacccaaaaaattctatgtcaaggagagtacataatgaaatacctactgccttctgcagcagctgggctggtgctgctcgctgcccaaccgacaatggcggcaaatacggggggttatgccaccactgacggcggcgacgtttctggtgcggtgaaaaaaacggcgcgttctctgcaagagatcgtcgatatcattgaagccgcgaaaaaggactcaagcggtaaagcggtcaaaggcggagcctacccgctcgttattacctacaacggtaatgaagatgcgctaatcaaagccgccgaagctaacatctgcggccagtggagcaaagatccgcgcggtgtggaaatcaaagagttcaccaaagggatcaccattctcggaaccaacggttcttccgctaacttcggtatctggatggttaactcttccaacgttatcgtacgtaacatgcgcttcggctatatgccgggcggtgcaaaagatggtgatgccatccgtatcgataattcaccgaacgtctggatcgaccacaacgagatcttcgccaagaacttcgaatgtgccggtacgccagacaacgacaccacctttgaatccgcggttgatatcaagaaagcctcaaccaacgtcaccgtgtcgtacaactatatccatggcgtgaaaaaggtagggttgagcggttcaagcaacacggataccggtcgtaacctgacttaccatcacaatatttacagcgatgttaactcacgtctgccgctgcaacgtggtggccaagtccatgcttataacaacctgtatggcggcatcaaaagttcaggctttaacgtccgtcagaaagggatcgcactgatcgaaagtaactggttcgaaaatgcgctcaacccagtgaccgcacgtaatgacgattccaacttcggtacttgggaactccgtaacaacaacattaccagcccatctgattttgctaaatacaacatcacctggggtaaaccatccacaccgcacatcaatgcggatgactggaagagcaccggtaaattcccagccgtcccatatagctactctccagtttctgcacagtgcgtgaaggataaactggcaagctacgctggcgtaggtaaaaaccaggcagtactgacagcagccaactgtaaataaacgcgttaagcccgacgcattcgttctgcgtcgggttcttcctgagcgagtgcttcggcctcgctcatttttgaaaggccggagcaagattgtcagcgtgaccgccatgaaaatagacgtcgtactcatgacaatttcaccaataagccgaggtctatttttcttttatcacgtaaagaaacgccatatagcgattaataatcgttatttcttaaaaaaactaaaattcgcgataaaactgactcatcacgcgaacaatattgaatacgtctgtgatagtatattttgacttaaggtagtgttttacgttgacggcagcgatcgccacaagaaaaataacaatttaaaaaccagccaataaagaaactcgagtgcatttattatctactaaaaaagtaaccttatgatttaccgttactttaaagggaaattattttctataaaaaataaaaccatccaatcatcagtattaccaaatgtttcatccgcaatacatttaacatttcacccttggactgatcttattttttgaccacactccccttggtttttcaccaaaattgaaattcatttttgttgaaaaatttacacttgttacatcgggcatagggatcgataaatgcccatgaaaattctattccaaggagacagtgataatgaaatacctattgcctacggcagccgctggattgctattactcgcggctcaacccgcaatggccgcaaatacgggcggctatgccactacggatggtggagaagtgtccggtgccgtgaaaaaaacggcacgttccatgaaagaaattgtggatattattgaagccgcgcaagtggattcaaaaggcaagaaagtcaaaggcggtgcttacccgctcatcatcacctatagcggtaatgaagactcattaatcaaagcggctgaaaagaatatctgcggccagtggagtaaagacgcacgcggcgtacaaatcaaagagttcaccaaaggcattactatccagggcaccaatggctcatccgccaacttcggtgtctggattgtgaactcttctaatgtcgtgctacgtaatatccgctttggctatatcccgggcggcgcgcaacacggcgatgccattcgtatcgataactccccgaacgtctggatcgaccacaacgaaatctttgccaagaactttgagtgtaaaggcacgccagacaatgacaccacctttgaatcggctgtcgatatcaaaaaagggtcaactaacgtcacggtatcctacaactatattcatggtatcaagaaagtcggcctgagcggcgcaagcaatacggatacgggccgtaacctgacttaccatcacaatatttatagcgatgttaactcacgcctgccgctgcaacgtggtggtctggttcacgcgtacaacaacctgtatgacggcatcaccggttcaggctttaatgtgcgtcagaaagggatcgcactgattgaaagcaactggttcgagaatgcgctcaacccagtgacagcacgtaacgacagctcaaactttggtacctgggagctgcgtaacaacaacatcacgaaaccggcagacttctccaaatacaaaatcacctggggcaagccttcctctcctcacatcaatgcggatgactggaagagcaccggtaagttccctgccgtctcctataagtacactccagtttctgcacagtgcgtgaaggataaactggcaaactatgctggcgtcggtaaaaacctggcagtactgacagcagctaactgcaaataaacgcggtcaggctttctccgtcgtcgcaagacaggaagcaataagtctgaatatcccgcgccgtgactcttcatacagaagcatggttctacccaagcgagcctcttagagctcgctcatttttttatggaaactcaggcgcgaacatggatatgcattcctaaagagcaggcataaattaaatatcaggctaattattaatataatgaattaatagcttgatttattaatggagaaaaccatcctttaattaatgattaatcaatagaaataacaacagcccatcaacacgtgattaattaataatttgatcggcatcaactatttctgacgccatcatctcagcgagtaataaaacgaaatataattttatttttcataaaactctcaatggcctaattttagaaaaaatgaaaaaaatattaccatttaaaataggcacttattagtctttgtgatttccaccgttactcactctatatatttaatatcgaaatattgaattcttttaattttatggtaagaattaatcgggatttcaataaaccttgatttcatttttattgaaacaccaaaataatataatctgggttatgtggatcataaatgcccaaacaaaaattctattccaaggagagtaccctaatgaaatacctactgccttctgcagccgctgggctgttattgcttgcggcccaaccaacgatggtggcaaatacggggggttatgccaccactgacggtggtgacgttgccggtgccgtgaaaaaaacagcgcgctccatgcaagatattattgatatcatcgaagccgcaaagctggattccaatggcaagaaagtcaaaggtggcgctttaccgcttgtcatcacctttatcggtaatgaagacgcgctgatcaaagccgctgaggccaacatctgcggccagtggagtaaggatgcccgaggtgtggaaatcaaagagttcaccaaagggattaccatccttggaactaacggatcgtccgccaacttcgggatctggctgacaaagtcatccgatatcgtcatacgtaacatgcgttttggttacatgccgggcggcgcgcaggatggcgatgccattcgtatcgataacacgccgaacgtctggattgaccacaacgagatcttcgcgaaaaactttgaatgcgcaggtacaaaagacggtgacacgacattcgagtccgcgattgatattaagaaagcttcgaccaacgtgaccatttcgtacaactacattcatggcatcaaaaaagtggggctgagcggcttcagcagcagcgatacgggccgtgacctgacttatcatcacaatatttacgacgacgttaacgctcgcctcccactgcaacgtggtggtcaggttcatgcctacaacaacttgtatactggcatcaccagctctggcctgaacgtgcgtcagaaagggattgcgctgatcgaacgtaactggttcgagaatgcgaaaaacccagtgacctcacgttatgacggttccaacttcggtacgtgggaactgcgtaataacaacgtcatgagcccagccgacttcgctaaatacaacatcacttgggataaagataccaaaccctacgtgaattccgaagactggaaaaacaccggtacgtttgcttctgttccttacagctactctccagtttctgcacagtgtgtgaaggacaaactggcgaactatgctggcgtgaaccaaaacctttccgtgctgtcagcagcaaattgcaactagttgcaaagcgtgaaaggtaaataagcgaatagcaggccccgcccctcattgtcctgtgctaactggagcctgcaaacaagcttaacgcccgtcggtttatcgttcgggccgcacttgagcgagccctaagggtcgctcatttttatcgttaatattcaaggaaatgaaatgaaacgttctcttctgttcgccgcactgttcagcaccggcttagtgtatagtgttggtataccgatggcgggcgccgacacaccggcagcaccagagttgaaaggattcggaacggataccgtagcaggcagcggtggacgcattattcgcgtcaccacgctagcctcttctggagcaggttcactcagggaagcgctggccgccaaaggaccgcgcattatcgtttttgaggttggcggcattatcgacctaaataaaagtgaccttcggttatcagaaccgtttgtcaccattgccggccagaccgctccctctcccggtatcaccatcattcgcggcggaatggggatcagcacacatgatgtgctgatgcagcatattcgtttccgcatcggcgatgccggtacgggtaaaaaaagcggctttgaacgcgatgtttccatcaacggcaaagatgcctacaacgtcgtgatcgaccactctagttttcgcctggggtacggacgaaaacctgtctatttccggcccacgctatgacggaccgcagggcaccgcacaccgcattacgctttcgaataatatcgttgctgaaggcctatacgattcggctcacaccaaaggtattcactcgatggggacgctggttcacgataacgtgaccgacgtatcgatcgtgggcagcctgtacgcgcacaacaacgagcgtaatgcctggtttaaagcaggttctacaggtgtcatggtcaataacctgatctacaaccccggcatttggggcgttcgcgttggtggcgtaaaaggagagtgggaagggaaaaccatgcccgccagcccacgcgtctccgttgcgggtaacgtgatgcactacggcacgaataccaaagcaggtttaggactggtaggaagcaacagctccggcgatgtctggatgtcagataacctcgcgtacgatgctcagggaaaagcggcaccgcaaacgtcaggcagtgggattaacttactcaaagtgtcccctatttggcctgcgggcttaacggcatcaccggccagcgccgtcaccaatcaggtactgcaaagcgcaggcgcgcgtcctaaaggtcgtgatgccgttgataaacgtatcgtggataatttcaaacagcggaaaggtggtttcgtgaacagccaggaagacgtcggcggctatcccgttgcaacagcgacctaccgtcagctgaacgtaccgagcactggcgtagatgcctggctacagcagatggccaacgcgctggaataaaacggcgctcatggaatagcagagtaaaatgctaaaaggccacatcagtggcctttgtcgtattctcggttctttgcttatctattttgccaatccgggcagcactttcgcggactgaatcacgactggcgtggtcggcacattctggtaaggcccgacattcttcgttggcacctgagaaatcttatccacgacgtccatgcccttcactactttaccgaacacggcgtagcccaaatcacgctggccatgatccccggg

SEQ ID NO: 2151 - protein, 374 aa, Erwinia carotovora
MKYLLPSAAAGLVLLAAQPTMAANTGGYATTDGGDVSGAVKKTARSLQEIVDIIEAAKKDSSGKAVKGGAYPLVITYNGNEDALIKAAEANICGQWSKDPRGVEIKEFTKGITILGTNGSSANFGIWMVNSSNVIVRNMRFGYMPGGAKDGDAIRIDNSPNVWIDHNEIFAKNFECAGTPDNDTTFESAVDIKKASTNVTVSYNYIHGVKKVGLSGSSNTDTGRNLTYHHNIYSDVNSRLPLQRGGQVHAYNNLYGGIKSSGFNVRQKGIALIESNWFENALNPVTARNDDSNFGTWELRNNNITSPSDFAKYNITWGKPSTPHINADDWKSTGKFPAVPYSYSPVSAQCVKDKLASYAGVGKNQAVLTAANCK

SEQ ID NO: 2152 - protein, 374 aa, Erwinia carotovora
MKYLLPTAAAGLLLLAAQPAMAANTGGYATTDGGEVSGAVKKTARSMKEIVDIIEAAQVDSKGKKVKGGAYPLIITYSGNEDSLIKAAEKNICGQWSKDARGVQIKEFTKGITIQGTNGSSANFGVWIVNSSNVVLRNIRFGYIPGGAQHGDAIRIDNSPNVWIDHNEIFAKNFECKGTPDNDTTFESAVDIKKGSTNVTVSYNYIHGIKKVGLSGASNTDTGRNLTYHHNIYSDVNSRLPLQRGGLVHAYNNLYDGITGSGFNVRQKGIALIESNWFENALNPVTARNDSSNFGTWELRNNNITKPADFSKYKITWGKPSSPHINADDWKSTGKFPAVSYKYTPVSAQCVKDKLANYAGVGKNLAVLTAANCK

SEQ ID NO: 2153 - protein, 374 aa, Erwinia carotovora
MKYLLPSAAAGLLLLAAQPTMVANTGGYATTDGGDVAGAVKKTARSMQDIIDIIEAAKLDSNGKKVKGGALPLVITFIGNEDALIKAAEANICGQWSKDARGVEIKEFTKGITILGTNGSSANFGIWLTKSSDIVIRNMRFGYMPGGAQDGDAIRIDNTPNVWIDHNEIFAKNFECAGTKDGDTTFESAIDIKKASTNVTISYNYIHGIKKVGLSGFSSSDTGRDLTYHHNIYDDVNARLPLQRGGQVHAYNNLYTGITSSGLNVRQKGIALIERNWFENAKNPVTSRYDGSNFGTWELRNNNVMSPADFAKYNITWDKDTKPYVNSEDWKNTGTFASVPYSYSPVSAQCVKDKLANYAGVNQNLSVLSAANCN

SEQ ID NO: 2154 - DNA, 1214 bp, BACILLUS SP.
tcaggctccgtacaaggggtgagcccgcagggtgcctgtagacaagccagcggcttgtttatcaaattacttaaattaagggaggatgttgatgatgaaaaaaatgttaacgctcttgctgtctgccggtcttgttgcttccatatttggtgtaatgcctgccgcggctgcgccaaccgtcgtcaattcaacgatcgttgtaccgaagggcacgacctatgatggacaggggaaaacctttgtagcgaatccctctacattaggtgacggttctcaagcggagaatcagaagcctgtattccggctggaagcaggggcaactttgaaaaatgttattattggtgcacccgcagcggatggtgtgcattgttacggcagctgtaatatttccaacgttgtatgggaagatgtaggcgaggatgcattgacactgaaatcatcaggaaccgttaatattaccggcggagcagcgtataaggcttacgataaagtgtttcagatgaacgcttcgggtacgattaatatcaaaaacttccgtgcggatgatatcggcaagctggtgcggcaaaatggaggaacctcctatgcggttaacatgacactggataattccaacatatccaacgtgaaggattccattatgcgcacggacagcagtgtatctcaagggaagatcacgaacacacgttactccaaagtgccaacgctgttcaagggctttgcttcaggcaagacgagccagtccggaaatacacagtattaacgcacgcttgcagtaaaaaataaagaagcggctgaagttcaagtaccacctgctcagccgttgaggagaaccaaataaaacgggatgaaccagtcaacatggcctcatcccgttttgatttggtttgtttggttacagccatgaatctgtatccatatcgaattacttctctccaggcacctcaacgaacagtttgccttgggatggagcagcagaaccgctatccaaggagccggatttgttcatgatctcataagcggtttcctccagcatgcgagaatatttgaaggataccagcgtttttccggctacagatggacgggttcctgcctcggcaacgggttttgccttgataaagaacaggtcaccaatggttccggcttgtttgctcagattggcttgccatttcaacagtgcatttccgttctccatcgtataataactgaccaga

SEQ ID NO: 2155 - protein, 222 aa, BACILLUS SP.
MKKMLTLLLSAGLVASIFGVMPAAAAPTVVNSTIVVPKGTTYDGQGKTFVANPSTLGDGSQAENQKPVFRLEAGATLKNVIIGAPAADGVHCYGSCNISNVVWEDVGEDALTLKSSGTVNITGGAAYKAYDKVFQMNASGTINIKNFRADDIGKLVRQNGGTSYAVNMTLDNSNISNVKDSIMRTDSSVSQGKITNTRYSKVPTLFKGFASGKTSQSGNTQY

SEQ ID NO: 2156 - DNA, 2434 bp, Erwinia chrysanthemi
aagcttacgtcaacgcggacagctggacctccaccggcactttcccgacggtggcctacagctacagcccggtgagcgcacaatgcgtgaaggacaatctggctaactacgccggcgtgggcaagaacctggcaacgctgaccagcgcacgctgtaaataatccggcagcgaaggccgggcatgaaaagcagcccggctgacgccctatcaccgagcgggctacacgcccgtctttttcttttcggtacgttccacgccttgtcaccatcagtccgatacggaacgcgacggacaaggctgagtgccttataccgatttcagccaatttgataattaatcatcttttaattatcaagcgttatgactaagtggtcagaactccggccactaaaagtgacgcctgtcaaaatttgtaaaaacataatcaccactaataatgaaattacgtttcaactattgaaacgtctcctttttgagctaaaactgagcgcgggttgattcgtgcgattcggttttacttatctatcccccaacgcattcgagtggcaggaaagcggttaacgcacctgcgacgtggagcgatgggatcccctgccgcaccaacccacaaccaagggcatgtggaacgataaatgcccatatcacatttttcaaaaacaggaatattactcatgaaatcattcattgcaccgattgccgccggtctgctgctggcttttagtcaatccagtctggctgcgactggcggttacgccaccacttccggtggtaacgtgacaggggctgtcagcaaaaccgcagcatccatgcaggacattatcgatatcatcgacgccgccaaagtcgattccaaaggtaagaaggtgaaaggcggcgcgtacccgctggtcatcacctataccggtaacgaagacagcttgatcaacgccgctgccgccaacatctgcggccagtggagcaaagacgcccgcggtgtggaaatcaaagacttcaccaaaggcatcaccattatcggcgccaacggttcttccgctaacttcggtctttggatcgtgaactcctccgacgtggtagtgcgcaacatgcgtatcggctacctgccgggcggcgcccaggatggcgatatgttccgtatcgacaactcgccgaacgtctggctggaccataacgaactgtttgccgccaaccacgagtgtgatggcaccaaagacggcgacaccacgttcgaatccgcctttgacatcaagaagggcgcaacttacgtcaccatttcctacaacaacatccacggcgtgaagaaagtcggtctggcagggttcagctcctctgacagcgccgaacgcaacatcacttaccaccacaacatctacaacgacgtcaacgcccgcctgccgttgcagcgcggcggcaacgtacacgcctacaacaacctgtacaccaacatcaccagctctggtctgaacgtacgtcagaacggcaaggcgctgatcgaaaacaactggttcgaaaacgcggtcaacccggtgacgtctcgttacgacggcagcaatttcggtacctgggtgctgaaaaacaacaacatcaccaaaccggctgatttcgccacctacaacatcacctggacggcggataccaaggcttacgtgaacgcagacagctggacttccaccggcacttacccggctgtgacctacagctacagcccggtcagcgcgcagtgcgtgaaggacaaactggctagctacgccggcgtcggtaaaaacctggccgagctgaccagcgctgcctgtaaataatcggttctcatcagccacgctgatgcctggaacccccatccgtccggcaagcccgggcgatggcggaaccgactatagagcgggagagcgacattcgctcgcccgcttttttatctagccgtgtcccaccgtgacaggacacgatccggcatatggagcaagccattatgaaacatacccttctgtttgctttactgttcagcaccagcgtcctgaccgttcaggccgccagcaccgccgcccccgacctgaaaggattcggaaccgagacggtcgccggcagcggcggaaaaatcatccgcgtgactacgctggactccggcggcgccggttcgctgcgtgaagcgctggccaccaaaggcccgcgtattatcgtgtttgaagtcggcggtattatcgacctggacgaaaaagatatccggctcgccgagccctacgtcactatcgccggccagaccgcgccatcaccgggcatcacgctggtcaagggcggcatgatgatcaccacccatgacgtactggtgcaacatatccgtttccgcatcggcgataacggccacgccaagaagagcggctttgaaaaagacgtatcgctctacggaccaaacgcctacaacgtggtggtggaccactgcag

SEQ ID NO: 2157 - protein, 374 aa, Erwinia chrysanthemi
MKSFIAPIAAGLLLAFSQSSLAATGGYATTSGGNVTGAVSKTAASMQDIIDIIDAAKVDSKGKKVKGGAYPLVITYTGNEDSLINAAAANICGQWSKDARGVEIKDFTKGITIIGANGSSANFGLWIVNSSDVVVRNMRIGYLPGGAQDGDMFRIDNSPNVWLDHNELFAANHECDGTKDGDTTFESAFDIKKGATYVTISYNNIHGVKKVGLAGFSSSDSAERNITYHHNIYNDVNARLPLQRGGNVHAYNNLYTNITSSGLNVRQNGKALIENNWFENAVNPVTSRYDGSNFGTWVLKNNNITKPADFATYNITWTADTKAYVNADSWTSTGTYPAVTYSYSPVSAQCVKDKLASYAGVGKNLAELTSAACK

SEQ ID NO: 2158 - DNA, 2018 bp, Erwinia chrysanthemi
agatcttctctgataaaggctcgatcatcaacggcgcttcgtacaatctgaatggttgcggctttggcttcagcgcatacagcgccaagatcccgtacaaatactcagcccaaaccatcaccaccagcctggcaaacagcatcagcagcaacgcgggctacggtaaactgtaatttcccgcccagcgtaaaggccacttgcaaaagtggcctttattttcccatattcccaccactcgtattaccccgatgttctccgaagcgccactcaatacggttcaggttaatccggccttgccacaggcgttcatcaagaaatcgaccggtttccccatcaaatgcagggactagcaggaattagtaagagacacagattaataaaattctatttaataaaaatcgaatcaattgttaactgtttgggttatttcagataaaaacgcttatacatatagctgaatttaaaagaaaaattaattcaacattcataactaaaagttaccggtcacgatcacactttagataaaattaattagcctcataaaaaaaacgagattttgatcacaaaataaacaatcgaaaacgcttaaaaatccgccttgccaaaggacaaaatggcgtttcatttttttcacaaacacttttcagtcaacaaaattggattagcgcagatagcgcaaggaaccagtctatgaacaacacacgagtgtcttccgtaggtaccaaaagcttgctggcagccatcatcgctacatcgatgatgacctggtcagtcaatgcagccacgctgcaaaccaccaaggcgacagaagcagcgtcaactggctgggcaacgcagggcggcggcaccaccggcggcgccaaagcagcctcagccaaaatctatgcagtaaaaaacatcagcgaatttaaagcagcactgaatggcaccgacaccgatccgaaaatcattcaggtgaccggcgctatcgatatcagcggcggcaaagcctacaccagctttgacgatcagaaagcccgcagccagatcagcgttccgtccaacaccaccatcatcggtattggcagcaatggcaaattcaccaacggctctctggtcatcaaaggcgtgagtaacgttatcctgcgtaacctgtatatcgaaacgccggtggatgtagcaccgcattacgaggaaggggatggctggaacgccgagtgggatgcggcggtgatcgacaattccacccgcgtttgggttgaccatgtcaccatcagcgacggcagcttcaccgatgacaaatacaccaccaaagacggcgaaaaatatgtgcagcacgacggcgcgctggatatcaagaaagggtccgactacgtcaccatttccagcagccgcttcgaactgcatgacaaaaccatcctgatcggccacagcgacagcaacggctcacaggactccggcaaactgcgcgttaccttccacaacaacgtgtttgaccgtgtaaccgaacgtaccccgcgcgtacgctttggtagcatccacgcatataacaacgtgtatctgggcgacgtgaaaaacagcgtctatccgtatctgtacagcttcggtcttggcaccagcggcagcatcctgtcggagtccaactccttcacgctctccaacctgaagagcattgatggcaaaaatccagaatgcagcatcgtgaagcaattcaacagcaaggtattctccgataacggctcactggttaacggctcgtcaaccactaagctggacacttgcggcctgacggcttacaaaccgactctgccgtacaaatattcggctcagaccatgacaagtagcctggctagcagcatcaatagcaatgcaggatacggcaaactgtaattcctctgccagtaaatcgcggccacttgaaaaagtggccgctttttgcatcaatcgcaggtaaaagaggtcatcatcatgctcacaactacctggaatcgcgccttttttctcggttccctgctttgtctgccgatatcttttgcgca

SEQ ID NO: 2159 - protein, 392 aa, Erwinia chrysanthemi
MNNTRVSSVGTKSLLAAIIATSMMTWSVNAATLQTTKATEAASTGWATQGGGTTGGAKAASAKIYAVKNISEFKAALNGTDTDPKIIQVTGAIDISGGKAYTSFDDQKARSQISVPSNTTIIGIGSNGKFTNGSLVIKGVSNVILRNLYIETPVDVAPHYEEGDGWNAEWDAAVIDNSTRVWVDHVTISDGSFTDDKYTTKDGEKYVQHDGALDIKKGSDYVTISSSRFELHDKTILIGHSDSNGSQDSGKLRVTFHNNVFDRVTERTPRVRFGSIHAYNNVYLGDVKNSVYPYLYSFGLGTSGSILSESNSFTLSNLKSIDGKNPECSIVKQFNSKVFSDNGSLVNGSSTTKLDTCGLTAYKPTLPYKYSAQTMTSSLASSINSNAGYGKL

SEQ ID NO: 2160 - DNA, 1047 bp, Bacillus halodenitrificans
atgatgagatcaagcatcgtcaagctagttgctttcagtgttgtggttatgttatggctcggtgtatcctttcaaacggcagaagcgaatacgccaaatttcaacttacaaggctttgccacgttaaatgggggaacaactggtggtgcaggtggagatgtagtgacggttcgtacagggaatgaattaataaacgctttgaagtccaaaaaccctaatcgtccgttaacaatttatgtaaacggtacgataacacctagtaatacgtctgatagtaagatcgatattaaggatgtttccaatgtatcgattttaggggttggtacaaatggacgattaaatgggatcggtattaaagtatggcgagcgaataatatcatcattcgcaacttgacgatccatgaagtccatacaggtgataaagatgcgattagcattgaagggccctctcggaacatttggattgaccataacgagctttatgccagcttgaacgttcataaagaccactatgacggcttgtttgacgtaaagcgcgatgcttacaatattaccttctcttggaattatgtccatgatggctggaaagcgatgctcatggggaactctgatagtgataactacgaccgaaacataacattccaccataactacttcaaaaacttaaactctcgcgtacctgcgtaccgttttggaaaggcgcacttgtttagcaattactttgagaacattttagaaacaggcattaattcacggatgggagcggaaatgctcgttgaacataacgtttttgagaatgccaccaacccgttaggattctggcatagcagtcgaacaggttattggaatgttgccaataaccgctatatcaatagcacgggtagcatgccgaccacttccacgaccaattatcgacctccttatccctatacggtcacaccagttggtgatgtgaaatcggttgtcacacgttatgcgggagttggtgtcatccagccgtatgcaagaaagccatccgagcgattgctctggtggctttttgcataa

SEQ ID NO: 2161 - protein, 348 aa, Bacillus halodenitrificans
MMRSSIVKLVAFSVVVMLWLGVSFQTAEANTPNFNLQGFATLNGGTTGGAGGDVVTVRTGNELINALKSKNPNRPLTIYVNGTITPSNTSDSKIDIKDVSNVSILGVGTNGRLNGIGIKVWRANNIIIRNLTIHEVHTGDKDAISIEGPSRNIWIDHNELYASLNVHKDHYDGLFDVKRDAYNITFSWNYVHDGWKAMLMGNSDSDNYDRNITFHHNYFKNLNSRVPAYRFGKAHLFSNYFENILETGINSRMGAEMLVEHNVFENATNPLGFWHSSRTGYWNVANNRYINSTGSMPTTSTTNYRPPYPYTVTPVGDVKSVVTRYAGVGVIQPYARKPSERLLWWLFA

SEQ ID NO: 2162 - DNA, 972 bp, UNCULTURED BACTERIUM CLONE
atggcaaaaatactgacattagacggtaacccggccgccagctggttcaacaaatccaggaccaagtggaatagcagccgcgccgatattgtgttgtcttaccagcaatccaacggcggttggccaaaaaacctggattacaactcagtgagcgcaggcaatggcgggagcgacagcggcaccatcgacaatggtgcaaccattaccgaaatggtttacctcgctgaaatttataaaaacggcggcaacaccaaatatcgcgatgcagtgcgcagagcagcaaactttttagtgagctcgcaatacagcacaggcgccttgccacaattttatccgttgaaaggcggctatcatgatcatgcgacctttaacgataacggcatggcgtacgcgttgacggtattggatttcgcagtaaacaaacgcgcaccgtttgataacgacattttctctgattctgatcgggcgaaattcaaaaccgctgttgccaaaggtgtggattacattttaaaagcgcagtggaaacaaaatggaaaactcactgcatggtgtgcacaacacggtgctttggattaccaaccgaaaaaaggtcgcgcttatgaattggaatcattgagtggtaaggagtcggtcggcattctcgccttcttgatgacccaaccacaaaccgcgcaaatcgaagcggcggtcaaggcgggtgtcaactggttcgccagtccaaatacttatttggctaactacacttacgattcatcaaaagcgtctaccaacccgattgtgtataaaaagggaagcagaatgtggtatcgcttctatgacctgtataccaaccgtggtttctttagtgatcgcgatggcagcaaattctatgatatcacccaaatgtcagaagagcgtcgcaccggttatagctggggtggctcttggggtgaagttattatttccttcgcgcaaaaagtgggttatctgtag

SEQ ID NO: 2163 - protein, 323 aa, UNCULTURED BACTERIUM CLONE
MAKILTLDGNPAASWFNKSRTKWNSSRADIVLSYQQSNGGWPKNLDYNSVSAGNGGSDSGTIDNGATITEMVYLAEIYKNGGNTKYRDAVRRAANFLVSSQYSTGALPQFYPLKGGYHDHATFNDNGMAYALTVLDFAVNKRAPFDNDIFSDSDRAKFKTAVAKGVDYILKAQWKQNGKLTAWCAQHGALDYQPKKGRAYELESLSGKESVGILAFLMTQPQTAQIEAAVKAGVNWFASPNTYLANYTYDSSKASTNPIVYKKGSRMWYRFYDLYTNRGFFSDRDGSKFYDITQMSEERRTGYSWGGSWGEVIISFAQKVGYL

SEQ ID NO: 2164 - DNA, 1023 bp, UNCULTURED BACTERIUM CLONE BD9113
atgttaagtttcatcgcggtatcagtgtttcataattactgcacagggcagacagcgtccaccaaaaattcagtggccgaaaagatgcttcagtaccagttgtcaaatggcgcctggcccaaacagttggtagacaaaagtgtcgttgattacagtcttccattaacgaaagagcgcctacagcagatcaagaaaacagatattgatcatgctacgctcgacaacagtgcgacaacccgggaaataactgaattgatcaaggcttttaaggacactaaaaataaggcatatttgactgctgtagaaaaggggattgcatatattttatcggctcaatatgagaatggcggatttccacaatactacccaaataaattatactatagagctgagataacatacaacgatgatgcgatgatcaatgcattactagtgctttacaaagtagccaataagcgagaggggtttgaggctatcaatcccatatttgtgtcaaaagcgcaaaaagcagttgaaaagggtataacctgtatcctaaaaacacaggtcatacaagacggaaaaaggagtatttgggctgcgcaatacgatcagaacactttacaacctgctcaggcaagaaagtttgaaccagcttcattgagcacaagtgaatctgtttccatcgttcgctttctcatgctacagcctgcaaccactgaaattaagcaagcgatcgaacatgcaatacaatggttcgaacagcatgatattgaaggttaccgtttcgaccgcatacaagatagggtgactggaaaatatcaacggcaacttgtcgcagatcggacttccacgatttgggcgcgattttataatctcgaagacaaccgcccattgtttggagatcgggacaatacaatcaaatacaactttgaggaggtttcagaggagcgtagaaatggctatgcttggttcggcaactggccggaaaagctgatccaaaaggactatccaaaatggaaaaaacaatacaaaattaaataa

SEQ ID NO: 2165 - protein, 340 aa, UNCULTURED BACTERIUM CLONE BD9113
MLSFIAVSVFHNYCTGQTASTKNSVAEKMLQYQLSNGAWPKQLVDKSVVDYSLPLTKERLQQIKKTDIDHATLDNSATTREITELIKAFKDTKNKAYLTAVEKGIAYILSAQYENGGFPQYYPNKLYYRAEITYNDDAMINALLVLYKVANKREGFEAINPIFVSKAQKAVEKGITCILKTQVIQDGKRSIWAAQYDQNTLQPAQARKFEPASLSTSESVSIVRFLMLQPATTEIKQAIEHAIQWFEQHDIEGYRFDRIQDRVTGKYQRQLVADRTSTIWARFYNLEDNRPLFGDRDNTIKYNFEEVSEERRNGYAWFGNWPEKLIQKDYPKWKKQYKIK

SEQ ID NO: 2166 - DNA, 1017 bp, UNCULTURED BACTERIUM CLONE BD9318
atgaagatatttttaacaatattgctctcggcattattcagcatttcaaatgcacaggtgctatcggatcctgttgcggatcgtatgaccagctaccaacttaaaaacggaggctggccgaagcacttggccgataaatctgttgttaactattcaaaacctctctcacctgctttgcaaaaagtcatcgatcaatcgaccgaaaagtctgcgacaattgataataatgcaaccacacgtgagataaaccatcttctcctcgcttattccaaaaccaacaatgacaagtatcttcaagcggcgacaaaaggtgttgagtatatcctgagtgctcaaaatgacaaaggaggatggcctcaatattatccagacagtagctcatatcgtggtcagatcacctacaatgacggcgcgatgattaatgtattggaaattttactttccatatcaacaaaacaagagccctatgctgttctaacgaataaatttaacgaaagaatagaaagggccttaacacgagggattcactgcatcttacaaacccaggttaaacaaggagataaactaaccatctgggccgcacagtacgatcagaaaacaatggaacctgctcaagccagactgtttgaaccggtagcgttagcgacagcggaatcggcgggcattctccgctttttaatgcgtcttgaccatcctactcccgaaataaaaaatgcaatcaaccacgctgtagaatggttttcctcccataaagaggtaggctatgattacgttaaaacggaaaaaaacggaaaacttttgcgggatttggtttcttcgccggcctctaccgtatgggcaagattttatgacatcaggacgaatcaacccatctttggtgatcgcgataatacgataaagtattcgctgaatgaaataagcgaggaacgacaaaatggctactcttggtatggtaactggccagaaaagataattacaaaagaatatgaaaaatggcttaagaaggtaaatgaataa

SEQ ID NO: 2167 - protein, 338 aa, UNCULTURED BACTERIUM CLONE BD9318
MKIFLTILLSALFSISNAQVLSDPVADRMTSYQLKNGGWPKHLADKSVVNYSKPLSPALQKVIDQSTEKSATIDNNATTREINHLLLAYSKTNNDKYLQAATKGVEYILSAQNDKGGWPQYYPDSSSYRGQITYNDGAMINVLEILLSISTKQEPYAVLTNKFNERIERALTRGIHCILQTQVKQGDKLTIWAAQYDQKTMEPAQARLFEPVALATAESAGILRFLMRLDHPTPEIKNAINHAVEWFSSHKEVGYDYVKTEKNGKLLRDLVSSPASTVWARFYDIRTNQPIFGDRDNTIKYSLNEISEERQNGYSWYGNWPEKIITKEYEKWLKKVNE

SEQ ID NO: 2168 - DNA, 1101 bp, UNCULTURED BACTERIUM CLONE BD8802
atgaacaccgcactgcaccgcgtcatccgcctgccgctgctgctggcgctgtgcctgcccgcgctgcaggcacaggccacgcagaccgagcccgtcgccgagaacatgctgctgctgcagaccgcgtccggcggctggtccaagcaccaccagggcaaggcggtcgactacggccacacgttcaccgatgccgaacgtgcggcgctgcgcgcgcccgaccgcagggacgatgcgacgatcgacaacaaggcgaccacgcttgagatcgtcgcgctgctggaagcccaccagcgcaccggcaatgccgcctatctggcggctgcgcagcgcggcgtggactacctgctggccgcgcagtacccgaacggcggctggccgcagtactacccggaccgttcgctgtaccggcaccaggtcaccttcaacgatgatgcgatgacccgcgtgctggagctgctgcaggacatcgtcgagggcaagggcgcgctggcgcagctgacacccacgcatggcgaacgcgccagggccgcgctcgacaggggcatcgcctgcgtgctcgccacccaggtacggatcgatggcgagctcacgctctgggccgcgcagtacgacgaagccacgctgcagccggcgaaggcgcgctcctacgagctgccatcgctggcggtcgccgaatcggtcggggtgatgcggctgctgatgcgccagccacagccgtcgccgcaggtgctgacggcggtcgaggccggcgcacgctggctggaggcgcaccgcatgcgcgacctggcccggcgaaagatcgacgcgcccggcgaagaaaccggccaggacgtggtgatcgtcgccgagcccggcgcgtcgctgtgggcacgcttctacgacctgcagcaccagcagccgatgttcgtgaaccgcgaaggcgagcaggtggcccgcttcgccgacatgcccaacgaacgccgcgtcggctacgcctggtatggcgtgtggccggagaagctgctgcagcaggagctgccacgctggtacaacacccatgccgaggcattgcgcgcgattacgcctgcgcatgccgagccaaggccgccgaagcggccctga

SEQ ID NO: 2169 - protein, 366 aa, UNCULTURED BACTERIUM CLONE BD8802
MNTALHRVIRLPLLLALCLPALQAQATQTEPVAENMLLLQTASGGWSKHHQGKAVDYGHTFTDAERAALRAPDRRDDATIDNKATTLEIVALLEAHQRTGNAAYLAAAQRGVDYLLAAQYPNGGWPQYYPDRSLYRHQVTFNDDAMTRVLELLQDIVEGKGALAQLTPTHGERARAALDRGIACVLATQVRIDGELTLWAAQYDEATLQPAKARSYELPSLAVAESVGVMRLLMRQPQPSPQVLTAVEAGARWLEAHRMRDLARRKIDAPGEETGQDVVIVAEPGASLWARFYDLQHQQPMFVNREGEQVARFADMPNERRVGYAWYGVWPEKLLQQELPRWYNTHAEALRAITPAHAEPRPPKRP

SEQ ID NO: 2170 - DNA, 1065 bp, UNCULTURED BACTERIUM CLONE BD9207
atgacgctacccgttgtttccctgcgcgtgctgctggcgctgctggccacgttgccggtcgcctgcgcgggcgctgcggtatccgcggcagcgaccgacccggtcgccgagaacatgctgctgctgcagaccgcctccggtggctggtccaagcactaccgcgggaagaaggtcgactacacgcgcaattacgacaccgccgagcgcgccgcgctgcgcgcgcccggccggcatgacgacgcgacgatcgacaacaaggccacgaccagcgagatcgcctacctggtgcaggcacatgccaggacgggcaacccggcgtacctcgacggtgcccgccgcggggtcgaatacctgctgcgcgcgcagtacccgaatggtggctggccgcagttctaccccgaccactcgtcctaccggcaccagatcacgctcaacgacgacgcgatggtgcatgccatcaccgtgctgcaggacatcgccgccggccgcgacggcatgcaggcgttgacgcccgagttcggcgtccgcgccgccgccgccgcgcagcgcggcatcggaaacctgctcgagttgcaggtgcggatcgacggcgagccgaccatctgggccgcgcagtacgacgagcatagcctgcagccggccaaggcccgcgcctatgaactgccctcgctggccgtggccgaatcggtcggcgtggtgcgcctgctgatgcgccagccgaggccggatgcccggaccgtcgccgcgatcgaatcggcggcccgctggctggaggcgcatcgcctgcatgacctggcgctcgaacgcgtcgacgcaccggccgaggaaacgggcaaggacgtgcgggtcgtgacccggcccggcgcctcgctgtgggcgcgcttctacgacctggatggacagcagcctctgttcgtcgaccgcgacagcaagcccgtcccgttcgccagcctgcccaacgagcgccgcaccggctatgcctggtacggcacctggccggagaagctgctggcgcaggaactcccgcgctggcgcgaggtccatgccgccggcgccgcgccctga

SEQ ID NO: 2171 - protein, 354 aa, UNCULTURED BACTERIUM CLONE BD9207
MTLPVVSLRVLLALLATLPVACAGAAVSAAATDPVAENMLLLQTASGGWSKHYRGKKVDYTRNYDTAERAALRAPGRHDDATIDNKATTSEIAYLVQAHARTGNPAYLDGARRGVEYLLRAQYPNGGWPQFYPDHSSYRHQITLNDDAMVHAITVLQDIAAGRDGMQALTPEFGVRAAAAAQRGIGNLLELQVRIDGEPTIWAAQYDEHSLQPAKARAYELPSLAVAESVGVVRLLMRQPRPDARTVAAIESAARWLEAHRLHDLALERVDAPAEETGKDVRVVTRPGASLWARFYDLDGQQPLFVDRDSKPVPFASLPNERRTGYAWYGTWPEKLLAQELPRWREVHAAGAAP

SEQ ID NO: 2172 - DNA, 1074 bp, UNCULTURED BACTERIUM CLONE BD9208
atgacgctacccgttgtttccctgcgcgtactgctggcgctgctggccacgtcgccggtcgcctgcgcgggcgccgcggcacccgcgactgcgaccgatccggtcgccgagaacatgctgcttctgcagaccgcctccggcggctggtccaagcactaccgcgagaagaaggtcgactacgcgcgcgactacgacgccgccgagcgcgccgcgctgcgcgcgcccgaccggcatgacgatgcgacgatcgacaacaaggccacgaccaccgagatcgcctacctggtgcaggcacatgccaggacgggcaatccggcctacctcgacggcgcgcgccgcggcgtcgagtacctgctgcgcgcccagtacccgaacggcggctggccgcagttctaccccgaccattcgtcctaccggcaccagatcacgctcaacgacgatgcgatggtgcacgccatcaccgtgctgcaggacatcgccgcgggccgcaacggcatgcaggtgctggcgccggagttcggcgtccgcgccgccgcggccgcgcagcgcggcatcggaaacctgctcgagttgcaggtgcggatcgccggggtgccgacgatatgggccgcgcagtacgacgagaccagcctgcaaccggccaaggcccgcgcgtacgaactgccttcgctggccgtggccgaatcggtcggcgtggtgcgcctgctgatgcgccagccggcgcctgatgcgcgcacggtcgccgcgatcgaggcggcggccgactggctggaggcgcaccgcctgccggacctcgccctggaacgcatcgaagcccccgccgaggaaaccggcaaggacgtccgcgtcgtggccagaccgggcgcgtcgttgtgggcgcgcttctacgacctcgagcggcaggtgccgctgttcgtcgatcgcaacagccgtccggtgcccttcgccgagcttcccaacgagcgtcgtaccggctatggctggtatggcacctggccggaaaagctgctggcacaggaactcccgcgctggcgcaaggtccatgcggccagcgcgggcgctccggcccgttga

SEQ ID NO: 2173 - protein, 357 aa, UNCULTURED BACTERIUM CLONE BD9208
MTLPVVSLRVLLALLATSPVACAGAAAPATATDPVAENMLLLQTASGGWSKHYREKKVDYARDYDAAERAALRAPDRHDDATIDNKATTTEIAYLVQAHARTGNPAYLDGARRGVEYLLRAQYPNGGWPQFYPDHSSYRHQITLNDDAMVHAITVLQDIAAGRNGMQVLAPEFGVRAAAAAQRGIGNLLELQVRIAGVPTIWAAQYDETSLQPAKARAYELPSLAVAESVGVVRLLMRQPAPDARTVAAIEAAADWLEAHRLPDLALERIEAPAEETGKDVRVVARPGASLWARFYDLERQVPLFVDRNSRPVPFAELPNERRTGYGWYGTWPEKLLAQELPRWRKVHAASAGAPAR

SEQ ID NO: 2174 - DNA, 1074 bp, UNCULTURED BACTERIUM CLONE BD9209
atgacgctacccgttgtttccctgcgcgtactgctggcgctgctggccacgtcgccggtcgcctgcgcgggcgctgcggcacccgcgactgcgaccgatccggtcgccgagaacatgctgcttctgcagaccgcctccggcggctggtccaagcactaccgcgagaagaaggtcgactacgcgcgcgactacgacgccgccgagcgcgccgcgctgcgcgcgcccgaccggcatgacgatgccacgatcgacaacaaggccacgaccaccgagatcgcatacctggtgcaggcacatgccaggacgggcaatccggcctacctcgacggcgcgcgccgcggcgtcgagtacctgctgcgcgcgcagtacccgaacggcggctggccgcagttctaccccgaccattcgtcctaccggcaccagatcacgctcaacgacgatgcgatggtgcacgccatcaccgtgctgcaggacatcgccgcgggccgcaacggcatgcaggtgctggcgccggagttcggcgtccgcgccgccgcggccgcgcagcgcggcatcggaaacctgctcgagttgcaggtgcggatcgacggggtgccgacgatctgggccgcgcagtacgacgagaccaccctgcaaccggccaaggcccgtgcgtacgagttgccctcgctggccgtggccgaatcggtgggcgtgatgcgcctgctgatgcgccagccggggcctgatgcgcgcacgatcgccgcgatcgaggcggcggcggactggctggaggcgcaccgcctgccggacctcgccctggaacgcatcgaagcccccgccgaggaaaccggcaaggacgtccgcgtcgtggccagaccgggcgcgtcgttgtgggcgcgcttctacgacctcgagcggcaggtgccgctgttcgtcgatcgcaacagccgtccggttccattcgccgagcttcccaacgagcgtcgtaccggctatggctggtatggcacctggccggaaaagctgctggcacaggaactcccgcgctggcgcaaggtccatgcggccagcgcgggcgctccggcccgttga

SEQ ID NO: 2175 - protein, 357 aa, UNCULTURED BACTERIUM CLONE BD9209
MTLPVVSLRVLLALLATSPVACAGAAAPATATDPVAENMLLLQTASGGWSKHYREKKVDYARDYDAAERAALRAPDRHDDATIDNKATTTEIAYLVQAHARTGNPAYLDGARRGVEYLLRAQYPNGGWPQFYPDHSSYRHQITLNDDAMVHAITVLQDIAAGRNGMQVLAPEFGVRAAAAAQRGIGNLLELQVRIDGVPTIWAAQYDETTLQPAKARAYELPSLAVAESVGVMRLLMRQPGPDARTIAAIEAAADWLEAHRLPDLALERIEAPAEETGKDVRVVARPGASLWARFYDLERQVPLFVDRNSRPVPFAELPNERRTGYGWYGTWPEKLLAQELPRWRKVHAASAGAPAR

SEQ ID NO: 2176 - DNA, 1077 bp, UNCULTURED BACTERIUM CLONE BD7597
atggcgccgatcctccgacccaacctcctttgcacttacgcgctctgcatgggcttgctcgccgtggtgagctgcgcggcggggccggtgtcagcgcagcagccggcgccatggagcacggccatcgtggagcaggaggagagcgcgttcgcctccccgtcgatgcgcagcgtcgccgacaacgtcgtgcgccatcagtcggccgaaggcggctggcctaagaacaccaatctggcggcgccgccatcggggccggcgccggagggcgtcgccaatacgatcgacaatgatgcgacgacgctgccgatggagtttctggcgcgtgtgatccacgccggcggcgtccgatacaagccggccttcgagcgcgggctggattatctgcttgcggctcagtacgcgaacggcggctggccgcagttctatccgctgcgcgggggctattacgatcacgtgacgttcaacgacgacgccatgatccgggtgatgattctgctcggcgcagtggcgcgcggcggggcgccctatgaatttgtcgacgccgggcggcgcgcgcgcgctgcagccgcggtcgagcggggcctggcgctcatcctgcgcacgcagatccggcagggcggggcgctgacggtctggtgcgcgcagtatgacagcgccaccttgcagcccgcctgggcgcgcgcctatgagccgccgtccctgtccggcgcggaaagtgtggggatcgtgcgctatctcatgtcgatcgaccatccctcgcccgaagtcgtcgccgccgtcgacggcgctgtggcatggctgcgcgcggccgccattgccggcgtgcgcgtggagaatttcacggacgccgacggccgccctgaccgccgcgccgtggccgacgcgggcgcgccgccgatctgggcgcggttctacgagttcggcgccaaccggccgatcttcctggggcgtgattccgtttttcactacacgttcggagaaatcgagcgcgagcggcgcgcaggctacaattattacggatactgggcgcgctccgtgctggaagactatccggcctggcgcgcgcgcgtgcgatga

SEQ ID NO: 2177 - protein, 358 aa, UNCULTURED BACTERIUM CLONE BD7597
MAPILRPNLLCTYALCMGLLAVVSCAAGPVSAQQPAPWSTAIVEQEESAFASPSMRSVADNVVRHQSAEGGWPKNTNLAAPPSGPAPEGVANTIDNDATTLPMEFLARVIHAGGVRYKPAFERGLDYLLAAQYANGGWPQFYPLRGGYYDHVTFNDDAMIRVMILLGAVARGGAPYEFVDAGRRARAAAAVERGLALILRTQIRQGGALTVWCAQYDSATLQPAWARAYEPPSLSGAESVGIVRYLMSIDHPSPEVVAAVDGAVAWLRAAAIAGVRVENFTDADGRPDRRAVADAGAPPIWARFYEFGANRPIFLGRDSVFHYTFGEIERERRAGYNYYGYWARSVLEDYPAWRARVR

SEQ ID NO: 2178 - DNA, 1203 bp, UNCULTURED BACTERIUM CLONE BD9561
atgcaattcatcgaaacacagcaattggggaccgccgcgaaacccgtggcgggacgaggaggcgacaggcgctttccgcgggtcatgcccgccgtttgcgcgggccttgccctcgccgtgtcgtcggccgagccggtccgggcgcagggcgcggatgcggatgcggatggcccactgcccaggtggaacaggaggctggtggatcgccccgaggactggttcgcctccgacgagggacagcgcgttgccgccaacgtcctccgctaccaatcggcggaaggagcctggcccaaaaacaccaatctggccgccactccccttcgccccgaggacattccctcctcgacctccggggtggccaacacgatcgacaatgaagccaccaccgtgcccattcggtttttggcccgtttcgcgcaaatcaacgaggacacggccagccgcgaggcggtccagcgcggattggactatctcctcaaggcgcaatatccgaacggtggctggccgcagtatttcccgctccgccgcggctaccactcgcacatcacctacaacgacgacgccatggtgaatgtgctcgacctgctgctggacgtgtcgctgggcgaggagccgttcgattttgtggacgaggatcgccgccagcgggccgcgaccgccgtggagcgggggatcgaatgcatcctccgcacccaaatccggcaggaggaccaacccaccggctggtgcgcgcagtatgaccccgaaaccttggccccggcgtggggacgggcgtacgagccgccgtcgatttccggagccgagaccgtcggcgtggcgcggtttctgatgcggctggagtcgccatcgccggaagccgtcgaagccatcgagggcgccatcgcctggctcgacacggtgggcatcgaggaattgcgtctcgaatggttcaccaacagcgagggcaagcgtgaccggcgcgtggtcgaggacgcttccgtgggcaccctttgggcgcgcttttacgaactcgaaacgaaccgccccttgttcgtggaccgcgacggggtgctccgctacgacttcgcggaactgacggcggagcgccgccaaggttacagctactacggcacttggccggcgccattgctggccacggaatatccgcgctggcgcaggatgaacgagtccgccctgctcgagtcgtccttcatctcgcattga

SEQ ID NO: 2179 - protein, 400 aa, UNCULTURED BACTERIUM CLONE BD9561
MQFIETQQLGTAAKPVAGRGGDRRFPRVMPAVCAGLALAVSSAEPVRAQGADADADGPLPRWNRRLVDRPEDWFASDEGQRVAANVLRYQSAEGAWPKNTNLAATPLRPEDIPSSTSGVANTIDNEATTVPIRFLARFAQINEDTASREAVQRGLDYLLKAQYPNGGWPQYFPLRRGYHSHITYNDDAMVNVLDLLLDVSLGEEPFDFVDEDRRQRAATAVERGIECILRTQIRQEDQPTGWCAQYDPETLAPAWGRAYEPPSISGAETVGVARFLMRLESPSPEAVEAIEGAIAWLDTVGIEELRLEWFTNSEGKRDRRVVEDASVGTLWARFYELETNRPLFVDRDGVLRYDFAELTAERRQGYSYYGTWPAPLLATEYPRWRRMNESALLESSFISH

SEQ ID NO: 2180 - DNA, 1125 bp, UNCULTURED BACTERIUM CLONE BD8806
gtgcatgcgggcgcgaaacacgtgagccgatggcgcgaagagttcctgcgcgacttcgccgcgcggctctcccgaaccattccgtcctcgccggcgcagagcgctgcggtcagcggggttccggcggcgatccgctggggagcggacgtcctgcggcagaagccggagtggtatgcctcgcgagaggcgaggacgatcgccgacagcgtcatccagtaccaggcggcggacggcggctggcccaagaacaccgacctcgggactccgcccacggctgaatcacgcgccggcgcggcggccgacgtgacgtcgagcaccatcgacaacaacggcacgacgatgccgatgcagttccttgcgctggtggcggacgcgaccggcgaggctcgctatcgcgcgtcgttcctccgcggcttcgactacctgctcgccgcgcagtatcccaacggcggctggccgcagttctttccgctccgccgcgggtattacacccacatcaccttcaacgacaacgcgatggtcaacgtgctgaccgtgctgcgcgatgccgcggccggtcaggcgccatacgccttcgtggacgagccccgccgcgcgaaggcccgcgccgccgtgtcccgggggatcgacgtcatcctgaagacccaagtgaaacagaacggcaagctgacggcgtggtgcgcgcagcacgacgagaagaccctcgcgccggcgtgggcgcgcgcttacgagccgccatcgctctccggcagcgaaaccgtcggcatcgtccgcttcctgatggagatcgagaagccgtcaccggagatcgtcgccgcgatcgaaggggccgtcgcctggctgaagtccgtggcgattccggggctgcgctacgagtccttcaccggcgcggacggacagagggaccgccgcgtcgttccggatccatcggccggactcctgtgggcgcggttctacgagctcggcaccaaccggccgatcttcctcggccgcgactccgtggttcgcgccgcgctcagtgacatcgaacgcgagcgccgcgccggctacgcctactacggtacgtggccggcgagcctgattgctgcggactacccgcgctggcgttcgacgctccggcgctga

SEQ ID NO: 2181 - protein, 374 aa, UNCULTURED BACTERIUM CLONE BD8806
MHAGAKHVSRWREEFLRDFAARLSRTIPSSPAQSAAVSGVPAAIRWGADVLRQKPEWYASREARTIADSVIQYQAADGGWPKNTDLGTPPTAESRAGAAADVTSSTIDNNGTTMPMQFLALVADATGEARYRASFLRGFDYLLAAQYPNGGWPQFFPLRRGYYTHITFNDNAMVNVLTVLRDAAAGQAPYAFVDEPRRAKARAAVSRGIDVILKTQVKQNGKLTAWCAQHDEKTLAPAWARAYEPPSLSGSETVGIVRFLMEIEKPSPEIVAAIEGAVAWLKSVAIPGLRYESFTGADGQRDRRVVPDPSAGLLWARFYELGTNRPIFLGRDSVVRAALSDIERERRAGYAYYGTWPASLIAADYPRWRSTLRR

SEQ ID NO: 2182 - DNA, 1131 bp, UNCULTURED BACTERIUM CLONE BD9837
gtgacgtgggatcagatccttcgtcagcctgccgcctggtacggcggtccggaagcgcgacggatcgcgaatctggtcctgctgtaccagcgcgcgacggggggctggcccaagaacatcgacatggcgcggtcgttgtctccggacgatcgcacgacgctcgcggcggaacgggccctcaccgactcgacgatcgacaatggatcgacgacgacgcagttgcggtttctcgcgatggtgcagcacgcccagcaggcacccgtgcgcgacgccatcacgcacggcctggactatctgctgaacgcgcaatactcgaacggcggatggccgcagtactttccgctccgagacgactactcgcgtcacatcacgttcaacgacgacgcgatgatcaatgtaatgacggtgctacgcgatgtcgcagaagctcgcatgcccttcgaagggatcgacgcggtccgtcgggaccgggcgcgtgtcgccatcacgcgtggcatcgacgtgattctcgggacgcaaatccgcgtcggggaccgtctgacgggctggtgccagcagcatgacgagcgctccctcgcccccaccaaggctcgcgcctacgagcacccatcgatcgccagcaaggaaacggtaaccatcacgcgcttcctcatgaccctcgatcgcccgagtcagcagatcatcgcggcgatcgaggcggctgtcgagtggttgcgcgtggcgaccctgtcgggtgtgcgagttgagcgtcggccggacccggcgagtccgaccggatatgacgtcgtcgccgcgccggatgccgccgcacctccgacctgggcacggttctacgagatcggcacgaaccgcccaatgttttccggccgcgacggcgtgatcagattccggctcgcggacatcgagattgagcgccgcaccggctacagctggatgggcgactatgccgcgaggttgctgaacgaggagtatccggcgtgggcgaggctacgccgggcgagctttcagaacgccgagctgcacaaggagtccggtgaagtcgtacacacggcgatcgtgcacgatcttgccttccttgatgtcgaagacaaagaccagccgcagccgaaagtgcttttcgctgggcggtag

SEQ ID NO: 2183 - protein, 376 aa, UNCULTURED BACTERIUM CLONE BD9837
MTWDQILRQPAAWYGGPEARRIANLVLLYQRATGGWPKNIDMARSLSPDDRTTLAAERALTDSTIDNGSTTTQLRFLAMVQHAQQAPVRDAITHGLDYLLNAQYSNGGWPQYFPLRDDYSRHITFNDDAMINVMTVLRDVAEARMPFEGIDAVRRDRARVAITRGIDVILGTQIRVGDRLTGWCQQHDERSLAPTKARAYEHPSIASKETVTITRFLMTLDRPSQQIIAAIEAAVEWLRVATLSGVRVERRPDPASPTGYDVVAAPDAAAPPTWARFYEIGTNRPMFSGRDGVIRFRLADIEIERRTGYSWMGDYAARLLNEEYPAWARLRRASFQNAELHKESGEVVHTAIVHDLAFLDVEDKDQPQPKVLFAGR

SEQ ID NO: 2184 - DNA, 1047 bp, UNCULTURED BACTERIUM CLONE BD7566
ttgccgcgtgcgcccggtggtgagtcgtcatcgccagcgcagacgtcatcggttgcggtctcctgggatcagatcctccgtcagcctgcggcctggtacggcggtgcggaggcgttgcgagtcgctgagaacgtgctcttgtatcagcgcgcggcaggagggtggccgaagaacatcaacatggcggcgccgatgaccgccgctgaccgtgcgaaagtcacggacgagcgcgcgcagaacgacgccacgatcgacaacacgtcaacgacgacgcagatccgttttcttgcgctcgttcttcgcggcaccgccgacgcacgattcaaggacgcggcgctgaagggcatcgacttcctgctggctgcgcaatacgcgaatggaggctggcctcagtattttcccctgcgcgacgactactcgcggcgcatcacgttcaatgacgacgcgatggtgaatgtgatgacgctgctgcgcgagacttcgcagggccagacgccgttcgagttcgtcgacgcctcgcggcgcggccgggcggcgcagtctgtctcacgcggcgtcgacgtcatgctgcgcacgcagattcgagtcaacggcgtgctgaccggctggtgccagcagcacgacgagcggaactttcagccggtgaaggcgcgcgcgtacgaacatccgtcgattgccagcaaggaaaccgcgagcatcgcaagattcctgatggggattgaacggccgtcgccggagatcgtgtccgcggtggatggcgcagtcgcgtggttgcgagcggcgcagatttcaggtgtgcggacggagcgccggcccgacggatcgaatccgggcggcgacgtcgtggcggtgcaggactccgccgcgccgccaatctgggcccgcttctacgagattggcaccaaccggccgatgttttcgggtcgcgacggcgtcatcaagtacagcctcagcgagatcgagatcgagcggcgcgctggatacagctggtacggcgactacgccgccagactgctcagagacgactatccgaagtggaagaaatga

SEQ ID NO: 2185 - protein, 348 aa, UNCULTURED BACTERIUM CLONE BD7566
MPRAPGGESSSPAQTSSVAVSWDQILRQPAAWYGGAEALRVAENVLLYQRAAGGWPKNINMAAPMTAADRAKVTDERAQNDATIDNTSTTTQIRFLALVLRGTADARFKDAALKGIDFLLAAQYANGGWPQYFPLRDDYSRRITFNDDAMVNVMTLLRETSQGQTPFEFVDASRRGRAAQSVSRGVDVMLRTQIRVNGVLTGWCQQHDERNFQPVKARAYEHPSIASKETASIARFLMGIERPSPEIVSAVDGAVAWLRAAQISGVRTERRPDGSNPGGDVVAVQDSAAPPIWARFYEIGTNRPMFSGRDGVIKYSLSEIEIERRAGYSWYGDYAARLLRDDYPKWKK

SEQ ID NO: 2186 - DNA, 996 bp, UNCULTURED BACTERIUM CLONE BD7563
gtggccaaggcgatcggcggtccgttgccgccggcaccagggcagggatcgccggtaacgtgggcgacgattctccggcagccatcgccgtggtacgcgtccgcggacgcgaaggcggttgccgaaaccgtgcgcgcgagccagagagccaccggcggctggccgaagaacacggattggacggcgctccagagcgacgctgagcggcaggcgctgcgaaatgcccgcgccgagaccgattcgacgatcgacaatggcgccacggtcaccgagcttcgctttctcacccgcgtgtatgtcgccacgcgcgacgagcttttacgggaggccgtgcttcgcggcctcgactacctgctggcgtcgcagtacagcaacggcggctggccacaatactttccgttgcggaccgattactcgcgggacatcacgttcaacgacgacgcgatgaccggcgtggtgctgctgctgaaggatgccgcggacgggtcagcaggtttcgaattcgtcgacaaggcgagacgtgaccgcgctgccgcggccgtgacgcgcgccatcgcggtgatcctccgcacgcagattcgggtcaacggtacgctgaccggctggtgccagcagtacgacgccgacgcgctgacgccggcgcgcgggcgctcgtacgagcatccgtcgattgcgagccgcgagacggtcgggatcgcgcggctgctgatgggcgtgccgaatccgtcgccagagatcgtggctgccgttgacgcggctgccgcatggttgggtaaatcggaactgaagggtgtgcccgaggcgacggcgccaggactttgggcgcgcttctacgacatcgctacgaatcggccgatctattcgggccgcgacggcgtcatcaagtaccggctcgacgagatcgagctcgagcggcgcacaggctacagctgggttggcccgtacgccgcggcatttctgacgaccgaatatccgaaatggcgggcggcacgatga

SEQ ID NO: 2187 - protein, 331 aa, UNCULTURED BACTERIUM CLONE BD7563
MAKAIGGPLPPAPGQGSPVTWATILRQPSPWYASADAKAVAETVRASQRATGGWPKNTDWTALQSDAERQALRNARAETDSTIDNGATVTELRFLTRVYVATRDELLREAVLRGLDYLLASQYSNGGWPQYFPLRTDYSRDITFNDDAMTGVVLLLKDAADGSAGFEFVDKARRDRAAAAVTRAIAVILRTQIRVNGTLTGWCQQYDADALTPARGRSYEHPSIASRETVGIARLLMGVPNPSPEIVAAVDAAAAWLGKSELKGVPEATAPGLWARFYDIATNRPIYSGRDGVIKYRLDEIELERRTGYSWVGPYAAAFLTTEYPKWRAAR

SEQ ID NO: 2188 - DNA, 987 bp, UNCULTURED BACTERIUM CLONE BD9170
atgactagacgcgccttcatcgcggttatctgtttcttcgcggccgtctgcgcgcacgcgcagtccaccgtgcgctggaaggacgtgctcgagcagtccgagggctggtattccacgaccgccgcgcacgtcgtcgccgacacggtgctgctgtatcaacgtccatccggtggatggccgaaggacatcgacatgacggcgccgccggcggaccgcactcctcccgcgcgtccagacgcgaccatcgacaacggcgccacgaccacgcagatccgcctgctcgctcgtgcggcctcgggcgcaccggcggctgccgcccacacctacacggcggcggcgcttcgcgggatcgattacctgctcgaggcgcagtatcccaacggcggctggccgcagttcttccccctgcgcaaggactattcgcgctacgtcacgttcaacgacgacgcgatgatgaacgtgatgttcctgctggacgaggtctcggcgggagatgcgccgttcacgttcgtggacgaacaacgccgcgaccgcgcgcgcgctgccgtcgccaagggggtctccgtcatcctgaagtcgcaggtccggatcgacgggacgctgaccgcctggtgcgcgcaacacgacgagatcaccctggcaccgcgtccggcgcgcaccttcgagcacgcgtcgctcagcggcaacgagtctgtcgcgatcgtgcgcttcctgatgacccgtccgccgacgccagcgatcgtcgccgcggtcgatgcggcggtcgcctggctcagacgcgtccgcctccctgacggacggtgggcccgattctacgagttcggtaccaatcgtccgatcttctcggggcgagacagtgtcgtgcgctacaaactcgaggagatcgaacaggaacgtcaggagggctacgcgtggtacggcacgtggccgaggacgcttgttgagaagatgtaccctgcatggaagtcgcggcttccgggcaagtag

SEQ ID NO: 2189 - protein, 328 aa, UNCULTURED BACTERIUM CLONE BD9170
MTRRAFIAVICFFAAVCAHAQSTVRWKDVLEQSEGWYSTTAAHVVADTVLLYQRPSGGWPKDIDMTAPPADRTPPARPDATIDNGATTTQIRLLARAASGAPAAAAHTYTAAALRGIDYLLEAQYPNGGWPQFFPLRKDYSRYVTFNDDAMMNVMFLLDEVSAGDAPFTFVDEQRRDRARAAVAKGVSVILKSQVRIDGTLTAWCAQHDEITLAPRPARTFEHASLSGNESVAIVRFLMTRPPTPAIVAAVDAAVAWLRRVRLPDGRWARFYEFGTNRPIFSGRDSVVRYKLEEIEQERQEGYAWYGTWPRTLVEKMYPAWKSRLPGK

SEQ ID NO: 2190 - DNA, 1080 bp, UNCULTURED BACTERIUM CLONE BD8765
atgagaatccggtcctcttcaatcgcgttcggcctgatttgcagtctggcgctaagggtgcctgcgcaagcgcaggtcaccgtgcgctgggcggacgtcctgaaccagcccgccgcctggtatggcaccgatgaagcccgtcgaattgccgaccacgtgctcgagcatcaacgagcggaaggcggatggccaaagaacacggacatgaccgcagcgcccgatccggcggtgctcacagccgcgcgagtgaagccagactcgacgatcgataacggcgcgaccgtcactgaaatgcgcgtcctcgcgcgcgtctaccgttcatcacccgatccccgttatcgcgatgcgctgctcaagggtctcgactatctgttggcagcgcagtatgccaacggcggctggccgcagttctacccgctccggcaggactattcgcgctatatcacgttcaacgacaacgcgatgatcaatgtcgtgacgctgctctcagacgtcgctgccggaaatggcgactgggcgtttgctgatgccagccggcgcgagaaaagccggacggctgtagagaaggccgtagaagtcatcctgcgcgcgcaggtgagagttgacggccggctgaccgcgtggtgcgcccaacacgacgaggtgacactcgagccgcgcaaggcccgcgcctacgaacatccgtcgctgagcggacaggagacggtggggatcatccggtttctcatgacccgcgataaaccggatcagagagtcgtcgatgcaatcgaggcgtcagtggcatggctgaaggcggtgcagctcaaaggacttcgcgtcgaccagcgccgcgatccctcgctgccggaggggcgtgacgtggtgaccgtcgctgacccgtcggcgccgccgctctgggcgcgcttctacgaaatcgggaccaatcgcccgatcttctctggacgcgacggcgtgatccgatactcgctggcagagatcgagcacgaacgccggatagggtacgcctggctcggaacctggcccgcgaagctgctcgataccgaatacccatcctggcgacggactcaacaaaggccgtga

SEQ ID NO: 2191 - protein, 359 aa, UNCULTURED BACTERIUM CLONE BD8765
MRIRSSSIAFGLICSLALRVPAQAQVTVRWADVLNQPAAWYGTDEARRIADHVLEHQRAEGGWPKNTDMTAAPDPAVLTAARVKPDSTIDNGATVTEMRVLARVYRSSPDPRYRDALLKGLDYLLAAQYANGGWPQFYPLRQDYSRYITFNDNAMINVVTLLSDVAAGNGDWAFADASRREKSRTAVEKAVEVILRAQVRVDGRLTAWCAQHDEVTLEPRKARAYEHPSLSGQETVGIIRFLMTRDKPDQRVVDAIEASVAWLKAVQLKGLRVDQRRDPSLPEGRDVVTVADPSAPPLWARFYEIGTNRPIFSGRDGVIRYSLAEIEHERRIGYAWLGTWPAKLLDTEYPSWRRTQQRP

SEQ ID NO: 2192 - DNA, 1071 bp, UNCULTURED BACTERIUM CLONE BD7651
atgccaaaaaattccgacgacgcgtggcgggaaaagactccgcccgattggagtcttgtcacatggagcgacgtattcaaacagaagcctctctggtaccaaaccgacgaggcggctcgagtcgcggaccaactcctcatctatcaaaaagagaacggcgggtttgagaagaatgtcgacatggcgttgatgctgacgcagaaggaaaaagaagagctcaccgcaaagcggtcagacgtctccgaaacgacgatcgacaaccggaccacgtatcctcaggtcgcgtatctcggtcgagtaatcaccgcaagccttcttaaaccttcgccgccggcgaatcttccgaaatacaaagacgccttcaacaaaggtcttgattacctgcttgcctcccagtatgagaacggaggatttccgcaattctatccgttgaaaaaaggctattacacacacatcaccttcaacgacgacgcgatgatcggcgtcctgaaggtgcttcgcgacatcgcaaataagaaagaggattacgtgttcgtggatgaagcgcgaagacttcgcgccgagcaagcggtcgccaaagcgctgcctcttattctgaagcttcaggttgtcgtcgacggaaagaaaaccgtctgggctgcgcagtatgacgagactacgctggcgcctgcagcggctcgcaagtttgagcccgtgtcgttgaccgctggtgagagcgtcggcatcgtccgatacctgatgcaggaaaaaccgacgccggagatcaccgatgcgatcgagtctgcgatcgattggtatcgaaagaacaagatcgacggaatacgttgggagcgcatcaaaggcgagaacacggttgtgaaagacaaatcggctccccctatatgggcacggttctatcagatcgaaacgatgcgtccgatcttcatcggacgtgattcggttatcaagtatgacgtgacgcaggtcgaagccgagcgtcggaatggttacgcctggtacgtcaccgcaccgaatgaattggtgaacgaggattatttgaagtggaaggggaaaagcgccggagccaagtag

SEQ ID NO: 2193 - protein, 356 aa, UNCULTURED BACTERIUM CLONE BD7651
MPKNSDDAWREKTPPDWSLVTWSDVFKQKPLWYQTDEAARVADQLLIYQKENGGFEKNVDMALMLTQKEKEELTAKRSDVSETTIDNRTTYPQVAYLGRVITASLLKPSPPANLPKYKDAFNKGLDYLLASQYENGGFPQFYPLKKGYYTHITFNDDAMIGVLKVLRDIANKKEDYVFVDEARRLRAEQAVAKALPLILKLQVVVDGKKTVWAAQYDETTLAPAAARKFEPVSLTAGESVGIVRYLMQEKPTPEITDAIESAIDWYRKNKIDGIRWERIKGENTVVKDKSAPPIWARFYQIETMRPIFIGRDSVIKYDVTQVEAERRNGYAWYVTAPNELVNEDYLKWKGKSAGAK

SEQ ID NO: 2194 - DNA, 1170 bp, UNCULTURED BACTERIUM CLONE BD7842
atggacaaacgcgtcaaatggattcatcagctttcaaaagaagaagcaaagcagttcgagcccgaaaatttcctcaaaggcaaagacggctggaatccgaaaaaggcggatgaccgctggctcgaaaaaacaaaacctgactggcagctcgttacgtggaacgacgcgttacgccaggcgccgctctggtatcaaaccgatgaagcggcgcgcattgccgaccaggtgattttgtaccagaaagacaacggcggctgggaaaaaaatctcgatatgacggcgatgctcacgcaagccgaacgcgaaaagctcgccaaagaaaaatcgaacacgtcggaaacgacgatcgacaaccgcacgacctacacgcaagtcgcttttctcgccaaagtcattacgggcagcttgcagaaaacgactccgccgaccaatttcccgaaacataaggaagcttttttcaagggcttggattacctgctcgcgtcgcagtacgaatcgggcggctttccgcagttttatccgctcaaaaaaggttattacacgcacatcacgttcaacgacgatgcgatgattggcgttttgaaggttttgcgcgaaatcgccaaaaagaaggaagactatctttttgttgacgaagaacgccgcctgaaagcggaaaaatcggtcgaaaaagcgctgccgctgattctgaaattgcaggttgaagtcggcggcaaaaaaacggtttgggcggcgcagtatgacgaaaacacttttaaacccgcagcggcgcgaaagtttgaaccggtttctttaacggcgggcgaatcggtcggcatcgtccggtttttaatgtacgattcaaagcccgaccaggcgacgattgacgcgattgaatctgccattcagtggtatcgcgcgaacaaaatcgaaggcattcgatgggtgcgcgaaaacggcgaaaaccgcgtcgtcaaggacaaaaacgcgccgccgatttgggcgcggttttacgaaatcgaaacgatgaagccgattttcatcgggcgcgacgccatcattcgttacgacgtgtctgaaatcgaagccgagcgccgcaacggctacgcgtggtacgtctcggagccgaacgagctgcttgaaaaagattacccgaaatggctggaaaaaattaaaaaatcagtaaagtaa

SEQ ID NO: 2195 - protein, 389 aa, UNCULTURED BACTERIUM CLONE BD7842
MDKRVKWIHQLSKEEAKQFEPENFLKGKDGWNPKKADDRWLEKTKPDWQLVTWNDALRQAPLWYQTDEAARIADQVILYQKDNGGWEKNLDMTAMLTQAEREKLAKEKSNTSETTIDNRTTYTQVAFLAKVITGSLQKTTPPTNFPKHKEAFFKGLDYLLASQYESGGFPQFYPLKKGYYTHITFNDDAMIGVLKVLREIAKKKEDYLFVDEERRLKAEKSVEKALPLILKLQVEVGGKKTVWAAQYDENTFKPAAARKFEPVSLTAGESVGIVRFLMYDSKPDQATIDAIESAIQWYRANKIEGIRWVRENGENRVVKDKNAPPIWARFYEIETMKPIFIGRDAIIRYDVSEIEAERRNGYAWYVSEPNELLEKDYPKWLEKIKKSVK

SEQ ID NO: 2196 - DNA, 1062 bp, UNCULTURED BACTERIUM CLONE BD7564
gtggatccaaagaattggaacccgaaaaaagccgacgattcatggctcgaaaagacgaaacccgattaccggctggtctcctggcgcgacgttttagatcaaactcagctctggtacgcggtcgacgaagcgacgcgcatcgccaaccaggttttgctctttcagcgcgataacggcggctgggaaaaaaacgtcgacatggcggcgatgctcactcaagccgaacgagaaaaactcgtcaaagaaaaatctcacaccgatacgaccatcgacaacggcgcgacgaccacgcagctgcgttatctggcaaaagtcatcacggcgaaaaacatcgaagctcataaacagtcgtttctcaagggattggattttctgctcgcgatgcagtatgaaaacggaggatttccgcaatattatcctttgaaaaacgattattcgcgcgagattactttcaacgacgacgcgatgatcaatgttcttaaattgctgcgcgacgtggcaaaaaagaaggaagattatttattcgtcgacgaagaccggcgcgccagagcggaaggcgcggtcgaaaaaggcgtccgcctgatcttgaaaacacaggtcgccatcgacggcaaaaaaacgatctgggcggcgcagtacgacgaaaacactttgaaaccggcaaatgcgagaaagtttgagcccgcctcgctcgcttcgcgcgaatcggtcagcgtggtcagatttttgatgctcgacgccaaacccgacgaggaaaaaatcggagcgatcgaatcggcgatcgaatggtttcaaaaaaacaaactgagcggcattcgctgggaatcgaaaagcggagaaaacctggtcgtcaaagacaaagcggcgccgccgatctggggaaggttttatcaattcgaaaccatgcgccccatttttatcgggcgcgacgcggtgattcgctacgatgtcatgcaaatcgaagccgaacgccgcaacggctacggctggtacacgaacgagccgaacgagcttttggacaaagattatccgaaatggaaagagaaaattaagaaaaattag

SEQ ID NO: 2197 - protein, 353 aa, UNCULTURED BACTERIUM CLONE BD7564
MDPKNWNPKKADDSWLEKTKPDYRLVSWRDVLDQTQLWYAVDEATRIANQVLLFQRDNGGWEKNVDMAAMLTQAEREKLVKEKSHTDTTIDNGATTTQLRYLAKVITAKNIEAHKQSFLKGLDFLLAMQYENGGFPQYYPLKNDYSREITFNDDAMINVLKLLRDVAKKKEDYLFVDEDRRARAEGAVEKGVRLILKTQVAIDGKKTIWAAQYDENTLKPANARKFEPASLASRESVSVVRFLMLDAKPDEEKIGAIESAIEWFQKNKLSGIRWESKSGENLVVKDKAAPPIWGRFYQFETMRPIFIGRDAVIRYDVMQIEAERRNGYGWYTNEPNELLDKDYPKWKEKIKKN

SEQ ID NO: 2198 - DNA, 1152 bp, UNCULTURED BACTERIUM CLONE BD7567
atgtcggttggaccaggtgctaatccgaaagctcgtgttccatggtccaaacagttatcgggtgttgaggcaaagctgtttcagcgcgagcggttcttcagcctcgctgcggagcacacttctaagaaaaatgatcaggaagtcggcgcgatcgcgtggaaagatgcacatggaaagccggatgagtggtatgcgagtgttgaggcactgcggatggccgataacgtcgttctctatcaacgcgactcaggtggttggcccaagaacatcgacatggcgaaggcactcaacgatcgtgagcaggctgcgatcctccgccagaagaaaaagaacgactccacgatcgacaatggtgcgactcacacacagttatcctttctggcgcgcgtctatacagcacagcgtcaggagcgacatcgcgagtcgtttttcaaaggattggattacttactgaatgcgcagtatccaaatggaggctggccgcagttttatccgaacccgacgggctatcacaagcacattacttacaacgacggtgcgatgattggtgtgatgaaggtgctgcgcgatatcgctgcggcgaagcctttgtacgcttttgtcgacgaagctcggcgcgcgaaggcgacgagtgcagttgaaaaagggatcgagtgcattttgaaaacgcaggtggtggtagatgggcgtcgcactgtgtggagtgcgcaacatgatgaagtaacgttagcgccagctcctgcgcgaaccttcgagttaacttcgttgagcggcggtgagagcgtagatatcgttcgatttttaatgtcgatcaaggatccgtcgcctaaagtagttgatgcggttgaatcggcggttaagtggtttgagcaatcggagttaaaaggcgtgaagtgggttaagaaggcggacgcttctaaacctggcgggtttgattgcgtcgtagttaaggatccggagagctcggtttgggcgcgcttttatgagattggcacgaaccggccgatcttttccgggcgcgatggagtggtcaaatacgacgtggcgcagatcgaacacgagcggcggacgaattatgagtggtacgttgatgaagcagccaagctgctgaagaaagagtatccggcctggcggaaaagaacatctctgtga

SEQ ID NO: 2199 - protein, 383 aa, UNCULTURED BACTERIUM CLONE BD7567
MSVGPGANPKARVPWSKQLSGVEAKLFQRERFFSLAAEHTSKKNDQEVGAIAWKDAHGKPDEWYASVEALRMADNVVLYQRDSGGWPKNIDMAKALNDREQAAILRQKKKNDSTIDNGATHTQLSFLARVYTAQRQERHRESFFKGLDYLLNAQYPNGGWPQFYPNPTGYHKHITYNDGAMIGVMKVLRDIAAAKPLYAFVDEARRAKATSAVEKGIECILKTQVVVDGRRTVWSAQHDEVTLAPAPARTFELTSLSGGESVDIVRFLMSIKDPSPKVVDAVESAVKWFEQSELKGVKWVKKADASKPGGFDCVVVKDPESSVWARFYEIGTNRPIFSGRDGVVKYDVAQIEHERRTNYEWYVDEAAKLLKKEYPAWRKRTSL

SEQ ID NO: 2200 - DNA, 1416 bp, UNCULTURED BACTERIUM CLONE BD8804
atgtcgtcacgacgcgagttcattagagatctgttgactggcggcgcactgatcgccgtcgcgccgcgtctgtctgcgtttgcagcggaggagaatccgtgggaaacggtgatgccttcgatcgtgaaacgcatcaagcgacctcgtttcccgatgcgcacgtttgatctcacggagtttggagcgaaaggtgatggacgaacagattgcacgttggctttccgtcgcgcgatcgatcgatgcacgaacgccggtggtgggagagtagttgttccaccgggttcgtatctcactggcgccattcatttgaagagcaacgtcgaccttcatatctcagaaggtactacggtcaagttcagccagaacccgaaagactacctgcccgttgttttctcgcgttgggaaggcgtcgaggtgttcaactactcgccttttatctacgccttcgaacaaacgaacattgcgatcactggcaagggcacgctcaacggtcaaagcgacaacgaacactggtggccctggaacggacgtgccgcgtacggctggaaagaagggatgagcaatcagcgtcccgatcgaaatgcgctgtttgcgatggccgaaaaaggtgtcccggttcaggagcgcatttttggtgagggccattacttaaggccgcagttcattcaaccttatcgttgtgagaacgtgctgatcgaaggtgtcactattcgaaactcgccgatgtgggaaattcatccggtgctctgccggaatgtcatcgtccaaaatgtgatcatcaacagtcatggtccaaacaacgacgggtgtaatcctgagtcgtgcacggatgtgttgattaaggattgtgacttcgacactggtgacgattgtatcgcgatcaagtcaggccgaaatgcagatgggcggcgactgaaggctcctactgaaaacattatcgtgactggttgtcgcatgaaagatggtcacggcgggattacggtgggcagcgagatttcgggtggggtgcgaaatcttttcgcatccaactgccggctcgacagtccgaacctggaccatgcattgcgggttaagaataacgctatgcgtggcgggctgttggagaatctgcacttccgaaatatcgacgtcgggcaagtggcgcacgcggtgatcacgatcgatttcaattatgaggaaggcgcgaagggatcgttcacgccagtcgttcgtgattacaccgtcgatggccttcgcagcacgaaaagtaagtacgcgctcgatgtgcagggcttggcgacggcgccgatcgtgaatctgcgtctaaccaactgcatcttcgacaatgtcgctgaaggaaatgttgtgaagaacgtaaaggatgcaactatcgagaatgtcaaaatcaatggaaaaagcgttgatgcagtgccgtag

SEQ ID NO: 2201 - protein, 471 aa, UNCULTURED BACTERIUM CLONE BD8804
MSSRREFIRDLLTGGALIAVAPRLSAFAAEENPWETVMPSIVKRIKRPRFPMRTFDLTEFGAKGDGRTDCTLAFRRAIDRCTNAGGGRVVVPPGSYLTGAIHLKSNVDLHISEGTTVKFSQNPKDYLPVVFSRWEGVEVFNYSPFIYAFEQTNIAITGKGTLNGQSDNEHWWPWNGRAAYGWKEGMSNQRPDRNALFAMAEKGVPVQERIFGEGHYLRPQFIQPYRCENVLIEGVTIRNSPMWEIHPVLCRNVIVQNVIINSHGPNNDGCNPESCTDVLIKDCDFDTGDDCIAIKSGRNADGRRLKAPTENIIVTGCRMKDGHGGITVGSEISGGVRNLFASNCRLDSPNLDHALRVKNNAMRGGLLENLHFRNIDVGQVAHAVITIDFNYEEGAKGSFTPVVRDYTVDGLRSTKSKYALDVQGLATAPIVNLRLTNCIFDNVAEGNVVKNVKDATIENVKINGKSVDAVP

SEQ ID NO: 2202 - DNA, 1104 bp, UNCULTURED BACTERIUM CLONE BD8113
atgaaaacgattctctcaaatctgaacgcggcgctgctttcatgcgccctgctctttgcggcagccacacagggaaccaagccgcccgaagtgcggtggaatgagtgcctaaaccaaaaacctgcctggtacggcagcccggaagcggtgcgcattgctgacaacctgttgctttaccaacgcgaccacggcggctggcacaagaatatcgaaatggctgcggtcttgaccgaacagcaacaggcagagttgaaagcgcaaaaggcaaccgacgattcgacgattgataacggcgcgacctatacccaggtgatttatctggcgcgcgtcttcaatgcgacgaagcaggagcgattcaaaaccgcgtttctcaaaggattcgattatctgctcaaggctcagtatgcgaacggcggctggccgcagtattacccgcgtttgcagggttattacaaacacatcacgttcaacgatgacgcgatggtcggcgtgcttgatcttctgcgcgatgttgcgcgcggcgattccggttatcggttcgtggacagcgaccggcgcgcccgcgccagccaggccgtgcaaaaaggaattgagtgcatcttgaaatgccagatcgtggtcgccgggaaaaagaccgcctggtgcgcgcaacacgatgaagtgacattcgcccccgcgccggcacgcacctacgagaaaatttcgctgagcggcagcgaatcggttggcctgatccgcttcctgatgggcattgaacaaccggacgcgcgtgtagttgaggcgattgagtccgccgttgcctggctcaagcaagccaagctgaccggcatcaaagtggttcagaaggcggatgcttcgaagcccaatggcttcgaccgggtcgtcgttgaagatgcacaagccgggccattgtgggcgcgcttttacgagatcggtacgggccgcccgatcttttccggacgtgacggcatcgtcaaatacagcttggcggaaatcgaacacgaacggcgcacgggctacggctggtacacgaatgcgcccgcgaaattgctggaacaagattatccggcctggcaaatcaaacgcgggggcaagaaaaagtaa

SEQ ID NO: 2203 - protein, 367 aa, UNCULTURED BACTERIUM CLONE BD8113
MKTILSNLNAALLSCALLFAAATQGTKPPEVRWNECLNQKPAWYGSPEAVRIADNLLLYQRDHGGWHKNIEMAAVLTEQQQAELKAQKATDDSTIDNGATYTQVIYLARVFNATKQERFKTAFLKGFDYLLKAQYANGGWPQYYPRLQGYYKHITFNDDAMVGVLDLLRDVARGDSGYRFVDSDRRARASQAVQKGIECILKCQIVVAGKKTAWCAQHDEVTFAPAPARTYEKISLSGSESVGLIRFLMGIEQPDARVVEAIESAVAWLKQAKLTGIKVVQKADASKPNGFDRVVVEDAQAGPLWARFYEIGTGRPIFSGRDGIVKYSLAEIEHERRTGYGWYTNAPAKLLEQDYPAWQIKRGGKKK

SEQ ID NO: 2204 - DNA, 1401 bp, UNCULTURED BACTERIUM CLONE BD8803
atgatcaatctttatggcgtctttgacatccggacctttggggcccaaccggacggagaaacgccttccactgcggcgattacggcggccatcgaaacttgtgccgcggccgggggaggagtggtctacatcccggccggacggttcctcaccggtcccctccgcctcaaaagccacgtccggctccatctcgaggccggagcgcacttgctctttagtcaggacccggccgattatcctgttctggagacgaggtgggaggggaaggaggtcttgacctatgcacaccagatctacggcgaggacctcgaaggggtcgcgattaccggtcgggggaccatcgacggccggggcgagacttggtggcgactcttccgcgccaaagccttcacccatccccgaccccgcctcatcgcctttacccgctgcaaggacatcctgatagaaggagtaaccctcgtcaattcaccggcctggaccatcaatcctgtgatgtgcgagcgggtgaccatcgataaggtgactatcatcaacccgcccgactcgcccaacaccgacgggatcgaccccgattcctcccggaacgtctatatcactaactgctacattgacgtaggcgatgactgcatcgccatcaaagcgggccgagaggactccctttatcggacgccttgtgaaaacattgtcatcgccaactgcctcatgcgccacggtcacggcggggtggtcatcggcagcgagaccagcgggggtattcgcaaggtagtcattaccaactgcatcttcgaggacaccgaccggggcattagacttaagtcccggcgcggacgcggcgggttcgtcgaggacctccgggcgacgaatattatcatggaaaaggtgctctgtcccttcgtcctcaacatgtactatgataccgggggaggcgtgatcgacgagcgcgcgcatgacttagaaccccatccggtaagcgaggctacaccctccttccgccgcctctccttcagtcacattactgcccgggaagtgcaggccgccgcggccttcctctacggcctgcccgaacagcctctggaggacgtcttatttgacgatatctggatagagctggccgccgacgcttctcctgcccgtccggccatgatgcgggccgtcccgcccatgagccaaggtggtgtgctctgctacggtgcgcggcggatctccttccggcacatgcacctccgcgggcaccgcggtccggccttccagatcgaacgcgcggaggcggtgcagttgatgggctgctcgaccgacggcagtgaagacccccagcttgtcttgggtcaagcggaggaggtcaccatccgtgactgcacctttaccgcccagcaggaccccgcaaaagaaaggcaaaattaa

SEQ ID NO: 2205 - protein, 466 aa, UNCULTURED BACTERIUM CLONE BD8803
MINLYGVFDIRTFGAQPDGETPSTAAITAAIETCAAAGGGVVYIPAGRFLTGPLRLKSHVRLHLEAGAHLLFSQDPADYPVLETRWEGKEVLTYAHQIYGEDLEGVAITGRGTIDGRGETWWRLFRAKAFTHPRPRLIAFTRCKDILIEGVTLVNSPAWTINPVMCERVTIDKVTIINPPDSPNTDGIDPDSSRNVYITNCYIDVGDDCIAIKAGREDSLYRTPCENIVIANCLMRHGHGGVVIGSETSGGIRKVVITNCIFEDTDRGIRLKSRRGRGGFVEDLRATNIIMEKVLCPFVLNMYYDTGGGVIDERAHDLEPHPVSEATPSFRRLSFSHITAREVQAAAAFLYGLPEQPLEDVLFDDIWIELAADASPARPAMMRAVPPMSQGGVLCYGARRISFRHMHLRGHRGPAFQIERAEAVQLMGCSTDGSEDPQLVLGQAEEVTIRDCTFTAQQDPAKERQN

SEQ ID NO: 2206 - DNA, 1170 bp, UNCULTURED BACTERIUM CLONE
atgaggtctaaaatcatcagcgccataaataattatagtgttattattctcgatggctcgaatggcgatttcactattagtgctacaatgagtttcagtagcaaatcaaacaaaaccatagttggtgtaaataatgctcgcctatgcaccaagttctatctaaccgatgaaataaagactgcgctcgatgctgctaatgtaaaatcagcaagttcaaccagtggaggtggtacactctcaaatgggaaatcagtgtcagaacaacgtgaataccttactcgtcaaacaattatcgatctaactggcgatgcttcggaatcgtgtcagaaagcgggcatctttagcttcagtagttgtaccaatatcatcatgcgaaacctcgttttggttggccctggcccatgcgatgtaggtggcaacgatttgctttcgctcactggttctaagcatttttgggtcgatcactgtgagttaaccgatggtatagatggcaatttcgatattaccaagagtagcgatttcaatactgttacttggtgtatattcaattataccgatcgtgcatacgaccacatgaactccaatcttattggtagctccgatagcgaagatgctgcctatttgaacactactatggcatgcaatatttggggctacaagtgcaatcagcgaatgccaatggctcgtgctggtaatattcaccttgtgaacaacttttacgattgcgctggcaatagtgtggctgttaaccctcgtaaaaattctgagttcttagtcgagaactgctactttgccacgggtgtgaagccattctcgcagagtggtgcgttgggatacaactttattgattgctatacagaagattcatacacttttcagcagagtggtacagtgtctgtgccatacgtttactctaagtttgatgtgcaattagtacccgagcaactcaataaatatgctggcgcaacgcttacttctccgcttgtcataggtcgggaagagggtgttgttactcctattagtgctgtctctgttgatagcgatgttgtgttggtcgaatactattcgctgactggtaatcgtgttaacacgctcaatagaggcatcaatatcgttagaactatttacgccaacggcaaagtaaccacacaaaaggttttggtgaaatag

SEQ ID NO: 2207 - protein, 389 aa, UNCULTURED BACTERIUM CLONE
MRSKIISAINNYSVIILDGSNGDFTISATMSFSSKSNKTIVGVNNARLCTKFYLTDEIKTALDAANVKSASSTSGGGTLSNGKSVSEQREYLTRQTIIDLTGDASESCQKAGIFSFSSCTNIIMRNLVLVGPGPCDVGGNDLLSLTGSKHFWVDHCELTDGIDGNFDITKSSDFNTVTWCIFNYTDRAYDHMNSNLIGSSDSEDAAYLNTTMACNIWGYKCNQRMPMARAGNIHLVNNFYDCAGNSVAVNPRKNSEFLVENCYFATGVKPFSQSGALGYNFIDCYTEDSYTFQQSGTVSVPYVYSKFDVQLVPEQLNKYAGATLTSPLVIGREEGVVTPISAVSVDSDVVLVEYYSLTGNRVNTLNRGINIVRTIYANGKVTTQKVLVK

SEQ ID NO: 2208 - DNA, 1449 bp, UNCULTURED BACTERIUM CLONE
atgcaatatggcaaattagtacgcttgtcggcactgacaacagcgctggcattcagcgccctggcacaggcaaataacctggcaattacaggccccggagccggggctgatggttccagcaaagccagtggcagtagctacggcgatgtaaaagacgccgatctgcaaagctactggcaaccgcctgctaataacggccaaagagtgtcggttaagtggagcagcgctatcagcgttaatcaggtaatactgcgtgaacagggcagtaatgtaaccagctggcggctggtaaataatgacaacggcgcagtattggcaaccggcaccagcattggcagcaacagaacggttaacttcagcactgtaagcacgaaaaaactcaatctggaaatactaactgccagcggtgccccgcgcattgctgagtttgaagtttatttaaataccaatggcggcaacccgccaaatcctactgacccggaaccaggcccggtaacttcttgcgcagcgtctccacagggctatgcctcgcttaacggtggcactaccggcggcagtggcagcaacgcggtcacggtaacggtaagcaccggcgctcaaatggtatcggcgctacaaaaccgcgatctaaaccggccgctcactatccgggttaatggcactatcacaccgggtaattctggcggtgtcagtaagtttgacattaaagatatggataatgtcagcattattggtgtaggcaacaatgcgttgtttgacggtatcggtattaaaatctggcgggccaataacgttattatccgcaaccttacaatgcgttatgttaacaccggcgataaagacgctattaccattgaaggcccggcgcgtaatatctggattgaccacaacgaaatctataacagcctgaatgtgggtaaagatttttacgacgagcttataagcggtaaaaaagacgtagataacgtaactatctcttacaactacctgcacgacagctggaaaacctcgctgtggggcagcagtgattccgacaactacaaccgccgtattacctttcaccataaccactggcataaggtaaattcacgcctgccactgttccgttttggccagggccatatttacaataactattacaacgacattcaggacaccggtattaacagccggatgggtgcggtaattcgtattgaaaacaatgtgtttgaaaacgcgaaaaacccgatagtgtcgttttattccagcggctacggttactgggacacccgcggtaatagctttagcaatattacctggcaggaataccccagcgacggcattatcgccgggccaaatgtacaacccacagcggtgctaaacctgccctacagctttaacctgttacccaccaaccaggtaaaagcccacgtactggccaacgccggcgtgaataaatgtagtttctaa

SEQ ID NO: 2209 - protein, 619 aa, UNCULTURED BACTERIUM CLONE
MFTTTGSHCARNSARFSLTAIAAAVALMAGTSAFAAATGGFSTTDGGNVSGARSFTASTYQQINTIIANAKLDDAGKKVTGGAYPLIITYTGNEDSLINQMIKDHTVNSSGNCPNPRWSEAYRYVEIKEFTKGITIQGANGSSANFGIVINKSDNVIVRNMKIGALAGASNDADMIRIDTGVNVWIDHNELFAVNNECKGSPDGDLTFESAIDIKKASQNITVSYNIIRDSKKVGLDGSSSSDIAGGRKITFHHNIYRNVGARLPLQRGGWTHMYNNLYDGVTSSGINVRQGGYALIENNWFQNAVNPVTCRFDSSNCGYWDLRNNNVRNPGDFSTYNITWTSGGTIDATNWTTTQPFPISIPYSYSPVSPQCVKDKLANYAGVGKNNAQLTASACSGNTSSVAPSSVPASSAAPSSRSSSSAAPSSTPTTSSSSSVAATGSISLGATATNNSIVLSWSPNNVTLGSQEVYRDTDADPSGRVRIASLAASARMYTDSTAASGQTYYYWIKNTTSGVVTNSNAASARIGSTASSSVASSSSSSSGGAPVLGGTGDYPSGFSKCADLGGTCSVSSGDGWVAFGRKGKWVTKKVSVGSSIACTVAAFGSDPQGNPNKCSYKR

SEQ ID NO: 2210 - DNA, 1047 bp, BACILLUS HALODURANS; identical to SEQ ID NO: 2160

SEQ ID NO: 2211 - protein, 348 aa, BACILLUS HALODURANS; identical to SEQ ID NO: 2161

SEQ ID NO: 2212 - DNA, 1698 bp, UNCULTURED BACTERIUM CLONE
atgtctactacaaaatgttttaacacagccccaggttttaccctgaaagcagtcgcagcagcagtggcgatgtttgcaggttcttcagtattcgcagcggctacaggtggtttttccacgactgatggcggtgcggcaagcggctcgcaatccttcacggcggccaaccttgaccagctcaacaccattgttgccaatgcgaagagtggcggttacccggttgtgattacctataccggtaatgaagacagcttgattaaccagatgatcaaagaccacaccgtggattcttcaggcaactgcccgaacccacgctggagtgaaacctaccgcaaggtagaaattaaggagatgaccaaaggtgtcaccatcatcggtgccaatggttcttcggcaaacttcggtattgtggtgaacaagtccagcaatgtgattatccgcaacatgaaaatcggtgcgctggccggtgccagcaacgacgcggatatgattcgtatcgatagcggcactaacgtatgggttgaccacaacgaattgttcgcggtgaacaacgaatgtaaaggttcaccggatggcgatttgaccttcgaaagcgccatcgacatcaagaaagattcacacaacatcaccgtgtcttacaacctgattcgcgacagcaaaaaagtgggccttgatggttccagcagcagcgatatcgccggtggccgcgagatcactttccaccacaacatttacaaaaacgtgaatgcacgcttgccgttgcaacgcggtggctggacgcacatgtataacaacctgtacgacggcattaccggttccggtatcaacgtacgtcaggccggttatgcgttgattgaaagcaactggttccaaaatgcggttaacccggtgacttgccgttacgacagcagcaactgcggtttctgggatctgcgcaataacaacgtgaagtcgccagcagatttcgcgacctataacatcacctggaccagcggcggcactattgatgcaaccaactggacgaccaccgctccgttcccgatcagcattccttacagctactcgccggtgtctccacagtgcgtgaaggacaagttggccagcgttgcgggtgtgggtaaaaacggtgcagttctgaactcatcagtgtgtggtggaagcagctctgttccatcatcaagctcagtcgctactacttccaaatcatccagctcggtagcaaccagcaagtccagctccgtcgctacgacgtccagtaagtcatccagctcggtagtgccatcatcatcaagctcaagttcagtggttaataacggcagcatcgcgttaaccgccactgctaccggcaatagcattgtcctgagctggtcgccgaacaacctgacactgggcacccaggaggtgtatcgcgataccgattcagacccaagtggccgtgtgcgtattgctgccctgagttccagcactcgcatgtacaccgatgccactgcatcggcgggccaaacgttctactactggatcaaaaacaccaccaacggtgtaaccaccaattccaatgcggcttcggcggcaattggcgatgcagctcgcgccattcgcgcatgcgcaggaaaccgaggaagtggcgctcgcaccagtcgcgcagtttcgactgggtcaaatcctcgtgggcctgccggtagccatcccagagcttga

SEQ ID NO: 2213 - protein, 565 aa, UNCULTURED BACTERIUM CLONE
MSTTKCFNTAPGFTLKAVAAAVAMFAGSSVFAAATGGFSTTDGGAASGSQSFTAANLDQLNTIVANAKSGGYPVVITYTGNEDSLINQMIKDHTVDSSGNCPNPRWSETYRKVEIKEMTKGVTIIGANGSSANFGIVVNKSSNVIIRNMKIGALAGASNDADMIRIDSGTNVWVDHNELFAVNNECKGSPDGDLTFESAIDIKKDSHNITVSYNLIRDSKKVGLDGSSSSDIAGGREITFHHNIYKNVNARLPLQRGGWTHMYNNLYDGITGSGINVRQAGYALIESNWFQNAVNPVTCRYDSSNCGFWDLRNNNVKSPADFATYNITWTSGGTIDATNWTTTAPFPISIPYSYSPVSPQCVKDKLASVAGVGKNGAVLNSSVCGGSSSVPSSSSVATTSKSSSSVATSKSSSVATTSSKSSSSVVPSSSSSSSVVNNGSIALTATATGNSIVLSWSPNNLTLGTQEVYRDTDSDPSGRVRIAALSSSTRMYTDATASAGQTFYYWIKNTTNGVTTNSNAASAAIGDAARAIRACAGNRGSGARTSRAVSTGSNPRGPAGSHPRA

SEQ ID NO: 2214 - DNA, 1782 bp, UNCULTURED BACTERIUM CLONE
atgttcactactaacagctctatttgcgcccggaaatccgcgcgtttttcactgactgccatggctgctgcggtggctatgatcgcgggcacctctgcctttgcggcctctaccggtggcttttcgaccacggatggcggcaatgtgtcagggtcaaaatcctttaccgcctcaagccacacccaaatccagcaaatccttgaggatgccaaagatggcaattatccggtggtgatcacctacaccggcaatgaggattcactgattaaccaagtcgtccgggatcacaccgtcgattcttcaggcaactgccctaaagcgcgttggaatgatgcctaccgcaaagtcgaaatcaaagaaatgaccaagggtgtcaccattcagggtgccaatggttcgtcggcgaatttcggaatcgtggtgaataaatccagcaacgtgattattcgcaacatgaagattggtgcactgggcggcgctaataacgatgcggatatgatccgtgtggacagcggtgtgaacgtctggatcgatcacaacgaattattcgccgtgaacaacgagtgtaagggttcacccgatggcgatctgacctttgaaagcgcgattgatatcaaaaaagcctcgcaagatatcaccgtgtcctacaacgtgattcgcgacagtaaaaaagtcggtttggatggctccagcagcagcgatatcgccggcggccgcaaaattactttccaccacaatatctaccgcaacgtaggtgcgcgcttacctttgcagcgcggcggttggacgcacatgtacaacaacctgtacgacggcattaccagctcgggcatcaacgtgcgccaaaacggttatgcgttaattgaaagcaactggttccaaaacgcggttaacccggtcacctgccgttttgacagcagcaactgcggcaagtgggatctgcgcaacaataacatccgcaacccgggtgattttgcgacttacaacatcacctggaccagtggcggcaccatcgacgccaccaactggaccaccactgcgcccttccctatcagcattccctacagctattcaccggttactccgcaatgtgtgaaagatcgtctggcgagttacgcgggtgtgggtaaaaacggcgcgcagctgactgcctcggcctgcggtggtgcggcatcgtccacacctgcatcgtccacacctgcaagttccagctctgcggcaaacagttccgctgcatcaggcagtgtgagtttgggtggcagtgccggtaatgcatcggttgcacttaactggaccgtgaatgccaacattaatgcgctggaaatttatcaggatacggattctgatcccgccggacgtgtgcgcattgcgtcgctgccaaccagcgcgaccaactacaccgcaacaggtctgagcaacggcactacctattacttctgggtgaaatatcgcaccaccaataatgtgtggagcaactccaatgtgttcagcgccaagccaagttcaggtacaaccccgtcatcatccagcagcgcggcttcatcaacgccaagtggtgcaccggtgttaagtggtacaggtgattacccaagcggcttctccaagtgtgctgatctgggtggcacctgctcagtcgcctcgggcgatggttgggttgcctttggtcgcaaaggcaagtgggtcaccaaaaaagtgtcagtcggtagctctattgcctgtaccgttgccgcgtttggatctgatccacaaggcaatcccaataagtgttcttataaaaagtaa

SEQ ID NO: 2215 - protein, 593 aa, UNCULTURED BACTERIUM CLONE
MFTTNSSICARKSARFSLTAMAAAVAMIAGTSAFAASTGGFSTTDGGNVSGSKSFTASSHTQIQQILEDAKDGNYPVVITYTGNEDSLINQVVRDHTVDSSGNCPKARWNDAYRKVEIKEMTKGVTIQGANGSSANFGIVVNKSSNVIIRNMKIGALGGANNDADMIRVDSGVNVWIDHNELFAVNNECKGSPDGDLTFESAIDIKKASQDITVSYNVIRDSKKVGLDGSSSSDIAGGRKITFHHNIYRNVGARLPLQRGGWTHMYNNLYDGITSSGINVRQNGYALIESNWFQNAVNPVTCRFDSSNCGKWDLRNNNIRNPGDFATYNITWTSGGTIDATNWTTTAPFPISIPYSYSPVTPQCVKDRLASYAGVGKNGAQLTASACGGAASSTPASSTPASSSSAANSSAASGSVSLGGSAGNASVALNWTVNANINALEIYQDTDSDPAGRVRIASLPTSATNYTATGLSNGTTYYFWVKYRTTNNVWSNSNVFSAKPSSGTTPSSSSSAASSTPSGAPVLSGTGDYPSGFSKCADLGGTCSVASGDGWVAFGRKGKWVTKKVSVGSSIACTVAAFGSDPQGNPNKCSYKK

SEQ ID NO: 2216 - DNA, 1860 bp, UNCULTURED BACTERIUM CLONE
atgttcactactactggctctcattgcgcccggaattccgcgcgtttttcccttactgcgatagcagccgctgttgcgttgatggcaggcacttcagcatttgcagctgcgacgggtggcttctctaccactgatggtggcaacgtatcgggcgcccgttcgtttactgcatcgacttaccagcaaatcaacaccattattgccaacgcaaaactggatgatgcaggtaaaaaagtcactgggggtgcttacccgcttatcattacctacaccggtaatgaagactcgctgattaaccagatgatcaaagaccacacggtgaattcatcgggcaactgccctaacccgcgttggagcgaagcctatcgctacgtggaaattaaagagtttaccaagggtattaccattcaaggcgcgaatggttcttcagcaaacttcggcattgtgattaataaatctgacaatgtgattgtgcgtaatatgaaaatcggtgcgcttgctggtgcgagtaacgatgcggatatgattcgtatcgacaccggcgttaacgtgtggattgatcacaacgaattgtttgcggtaaataatgaatgtaaaggttcacccgatggtgacctgacatttgaaagtgcgattgatattaaaaaagcatcgcaaaatattacggtgtcctacaacattatccgcgatagtaaaaaagtagggctcgatggttcgagtagcagtgatattgcaggtggccgtaagattacgttccatcacaatatttatcgcaatgttggtgcacgtttaccgttgcaacgcggtggttggacacacatgtataacaatctttacgacggagttaccagctcgggtattaacgttcgtcaaggtggctacgcgctaatcgagaacaactggttccaaaatgctgtcaacccggttacctgccgttttgacagtagtaactgcggttactgggatctgcgcaacaacaacgtgcgcaaccctggtgatttctccacctacaacattacctggaccagcggtggcaccatcgacgccaccaactggactaccactcaacctttcccgattagcattccttacagctactcgcctgttagcccgcagtgtgtcaaagacaagttggcaaattatgctggtgtcggtaaaaacaatgcgcaattaacggcgtctgcgtgcagcggaaatacttcatcggtagcaccttcatcagtgccagcatcatcggcggcaccttcaagccgttcatccagcagtgcagcgccatccagcacaccaactacatcaagctcgagttcagttgccgcaaccggttcaatttcgctcggtgcaacggcaaccaacaacagcattgtgttgagttggtcacccaacaatgtgacgctcggttcgcaagaagtgtatcgcgataccgacgctgatccatcggggcgtgtgcgtatcgcatccctggctgcttcagcgcgtatgtataccgatagcacagcggcatcgggccaaacctattactactggattaaaaataccacttctggtgttgtcaccaattccaatgctgcatcagcgcgtattggtagcacggcgtccagttctgttgcatcaagcagctcaagttcaagcggcggcgcgcccgtattaggtggtactggtgattatccaagcggcttctccaagtgcgctgatttgggcgggacttgttcagtgtcatcgggcgatggctgggttgcgtttggtcgcaaaggcaagtgggttaccaagaaagtatcggtaggtagttcaatcgcctgtaccgttgcggcatttggttcggatccacagggcaaccctaacaagtgttcttacaaacgttaa

SEQ ID NO: 2217 - protein, 619 aa, UNCULTURED BACTERIUM CLONE; identical to SEQ ID NO: 2209

SEQ ID NO: 2218 - DNA, 2043 bp, UNCULTURED BACTERIUM CLONE
atgaaaacctccagagcaatttttactacatcaacacttttacaccgcgcgcttatcgcggctagtgtcagcatggcaatgagttctgccgcatgggcgggttgtacctataccgtcaccaataattggggctcaggatttaccggcgaaatcaaagtgaccaacaacaccaccgccagcgtgaacaattggtctgtgtcatggcaggaatccggtgcggctatcaccaacgcctggaatgcaacgctcagtggctcaaacccttacacagccgtatccgctggttggaatggcacacttgcccccaatgcatcggccacttttggtttccaggcaaacggttctgccggtgcacctaaagtgaatggcagcttgtgcggcaccaacacttcatcaacaccggcatccagcagtgttgccagctcggttaaatcaagcgcgcccgtatcgtccagcagcagatcatccagttcaatcgctatcactagcagctctttagcgagaagttctattgcctccagcagctcactagttagtagctccagagcgagcagtagtgcgccaagcgttttctcttttacgatccaggaagagcaagcgggcttctgtcgtgttgatggcattgcgacagaaagcaccaacaccggttttaccggcaatggctacaccaatgcgaacaacgcgcaaggcgcagcgattgaatgggcagtcagcgcacctagcagtggccgttatacagtagccttccgcttcgccaatggcggcacagcagcgcgcaacggctcgttgttaatcaatggcggtagcaatggtaattacactgtggagttacccctgaccggcgcatgggcaacctggcaaattgccagcgtggaaattgatttagtgcaaggcaataatattttaaaactctcggcgttaaccgctgacggtttggccaatatcgactcattaaaaatagacggcgcgcaaaccaaagcaggtacttgcagcactacatcaagcagcagcgttgccagcagctcgtcgtccgttaaatccagcgcaagttcttcttcgagttcatccaccgctgcaaaaatactgacattagacggtaacccggccgccagctggttcaacaaatccaggaccaagtggaatagcagccgcgccgatattgtgttgtcttaccagcaatccaacggcggttggccaaaaaacctggattacaactcagtgagcgcaggcaatggcgggagcgacagcggcaccatcgacaatggtgcaaccattaccgaaatggtttacctcgctgaaatttataaaaacggcggcaacaccaaatatcgcgatgcagtgcgcagagcagcaaactttttagtgagctcgcaatacagcacaggcgccttgccacaattttatccgttgaaaggcggctatgcggatcatgcgacctttaacgataacggcatggcgtacgcgttgacggtattggatttcgcagtaaacaaacgcgcaccgtttgataacgacattttctctgattctgatcgggcgaaattcaaaaccgctgttgccaaaggtgtggattacattttaaaagcgcagtggaaacaaaatggaaaactcactgcatggtgtgcacaacacggtgctacggattaccaaccgaaaaaagcgcgcgcttatgaattggaatcattgagtggtagcgagtcggtcggcattctcgccttcttgatgacccaaccacaaaccgcgcaaatcgaagcggcggtcaaggcgggtgtcaactggttcgccagtccaaatacttatttggctaactacacttacgattcatcaaaagcgtctaccaacccgattgtgtataaatccggaagcagaatgtggtatcgcttctatgacctgaacaccaaccgtggtttctttagtgatcgcgatggcagcaaattctatgatatcacccaaatgtcagaagagcgtcgcaccggttatagctggggtggctcttacggtgaatctattatttccttcgcgcaaaaagtgggttatctgtaa

SEQ ID NO: 2219 - protein, 680 aa, UNCULTURED BACTERIUM CLONE
MKTSRAIFTTSTLLHRALIAASVSMAMSSAAWAGCTYTVTNNWGSGFTGEIKVTNNTTASVNNWSVSWQESGAAITNAWNATLSGSNPYTAVSAGWNGTLAPNASATFGFQANGSAGAPKVNGSLCGTNTSSTPASSSVASSVKSSAPVSSSSRSSSSIAITSSSLARSSIASSSSLVSSSRASSSAPSVFSFTIQEEQAGFCRVDGIATESTNTGFTGNGYTNANNAQGAAIEWAVSAPSSGRYTVAFRFANGGTAARNGSLLINGGSNGNYTVELPLTGAWATWQIASVEIDLVQGNNILKLSALTADGLANIDSLKIDGAQTKAGTCSTTSSSSVASSSSSVKSSASSSSSSSTAAKILTLDGNPAASWFNKSRTKWNSSRADIVLSYQQSNGGWPKNLDYNSVSAGNGGSDSGTIDNGATITEMVYLAEIYKNGGNTKYRDAVRRAANFLVSSQYSTGALPQFYPLKGGYADHATFNDNGMAYALTVLDFAVNKRAPFDNDIFSDSDRAKFKTAVAKGVDYILKAQWKQNGKLTAWCAQHGATDYQPKKARAYELESLSGSESVGILAFLMTQPQTAQIEAAVKAGVNWFASPNTYLANYTYDSSKASTNPIVYKSGSRMWYRFYDLNTNRGFFSDRDGSKFYDITQMSEERRTGYSWGGSYGESIISFAQKVGYL

SEQ ID NO: 2220 - DNA, 1977 bp, UNCULTURED BACTERIUM CLONE
atgaataactcaacaaaaaaaatgattcggccactcaaggcatcttttgccttgggcgctctcgcactggcaatcgcatcaccctcatgggcggcttgctcttacagcgtaaccaataattggggctctggctttaccggagaaattaaagtaaccaacgatacaacatcgactgtaaataattggtctgtgtcttggcaggaatcaggcgtgaccgtcactaacgcatggaatgcaacactgagcggatcaaatccttataccgcaacatcactcgggtggaacggaactctcgctccaaaagcttcagcaagttttggttttcaagcaaatggaacagcgggcgcaccgaaagtaaatggaaccttgtgtggtaccagcacatcatcaacaggtacatcctcagttgcaccttcatccgtagcgagtagcgttgctgtatcaagcagtaaatcatcaagctctgttgcaaccatcagtagctctaaatccagcagcagtgtgccgacagtttcatcattcactattcaggaagagcaagccggtttctgccgtgtagatggcattgcaactgaaagtactaacactggctatacaggtaatggctacaccaacaccactaatgcgcaaggcgctgcaattgaatgggcaattaatgctcccaacagcagccgctacaccctcaccttccgttatgccaatgctggtaccgctaatcgcaatggttcgttattaattaacgacggaagcaatggtaactacacagtgcaattgccaagtaccggcgcatgggcaacctggcaaaccgtcagtgttgaagtggatttggtgcaaggcaataatattttgaaactcgcttcgcttactgctgatggccttgcgaatatagattcattaaaaattgaaggcgcacaagccaaagctggtgtatgcagcactacggtaagtagcagctcttcgtcaattaaatcaagttccagttcatcatcgtccagctcaactgcagcagtaaaaacattaacactggatggtaaccctgctgcaaactggtttaataaatccagaaccaagtggaatgtcagcagagctgacatcgtactttcgtatcagcaatcaaatggtggctggccaaaaaatttggactacaactcggtaggctcaggtaatggtggtagcgacagcggcactattgataatggtgcaaccataaccgaaatggtgtacctcgctgaagtgtataaaaatggcgggaataccaaataccgcgacgccgtgcgcagagcagcgaattttattgtgagttcacaatacagcactggtgctttaccgcagttttatccgctgaaaggtggttacgcagatcacgctacctttaatgataatggtatggcttacgcgttgactgttctggatttcgcggtaaataaacgcgcgccatttgataacgatattttctctgactctgaccgcagcaaatttaaaactgctgttaccaaaggcgtcgattacatattaaaagcgcaatggaaacagaatggaaaattaaccgtatggtgcgcacaacacggtgctaatgattatcaaccgaaaaaagcgcgtgcttacgagttagaatcattgagtggtagtgaatctgtcggtgtactcgctttcttaatgactcaaccacaaaccacgcaaattgaagcagctgtgcgtgcaggtgtggcctggtttaatagcccaagcacctacttgaataattacacttacgattcttccaaagcttcgaccaatccaatcgtgccaaaatccggaagcaaaatgtggtatcgcttttatgacctgaataccaaccgcggtttcttcagtgatcgtgacggcagcaagttctacgacatcacccaaatgtcagaagagcgtcgcactggttacagttggggtggtgactacggcagctcgattatcagcttcgcacaaaaagtgggatatctctaa

SEQ ID NO: 2221 - protein, 658 aa, UNCULTURED BACTERIUM CLONE
MNNSTKKMIRPLKASFALGALALAIASPSWAACSYSVTNNWGSGFTGEIKVTNDTTSTVNNWSVSWQESGVTVTNAWNATLSGSNPYTATSLGWNGTLAPKASASFGFQANGTAGAPKVNGTLCGTSTSSTGTSSVAPSSVASSVAVSSSKSSSSVATISSSKSSSSVPTVSSFTIQEEQAGFCRVDGIATESTNTGYTGNGYTNTTNAQGAAIEWAINAPNSSRYTLTFRYANAGTANRNGSLLINDGSNGNYTVQLPSTGAWATWQTVSVEVDLVQGNNILKLASLTADGLANIDSLKIEGAQAKAGVCSTTVSSSSSSIKSSSSSSSSSSTAAVKTLTLDGNPAANWFNKSRTKWNVSRADIVLSYQQSNGGWPKNLDYNSVGSGNGGSDSGTIDNGATITEMVYLAEVYKNGGNTKYRDAVRRAANFIVSSQYSTGALPQFYPLKGGYADHATFNDNGMAYALTVLDFAVNKRAPFDNDIFSDSDRSKFKTAVTKGVDYILKAQWKQNGKLTVWCAQHGANDYQPKKARAYELESLSGSESVGVLAFLMTQPQTTQIEAAVRAGVAWFNSPSTYLNNYTYDSSKASTNPIVPKSGSKMWYRFYDLNTNRGFFSDRDGSKFYDITQMSEERRTGYSWGGDYGSSIISFAQKVGYL

SEQ ID NO: 2222 - DNA, 1977 bp, UNCULTURED BACTERIUM CLONE; identical to SEQ ID NO: 2220

SEQ ID NO: 2223 - protein, 658 aa, UNCULTURED BACTERIUM CLONE; identical to SEQ ID NO: 2221

SEQ ID NO: 2224 - DNA, 1224 bp, UNCULTURED BACTERIUM CLONE
gtggaattaccagtaaccggcgcatgggcaacctggcaaaccgcaactgttgaaattgatttggtgcaaggtaacaacctgttaaaactttctgcgatcacggctgatggtttggcaaatatcgattcgttgaaaattgacggcgcacaaaccaaagccggcgtgtgcagcactgtggcaagcagcagctcttcatccgttgcttcatcgattaaatcaagctccagttcatcctcttccagttcaacgacgacggtaaaaacattaacactggatggcaaccccgcagcaaactggtttaacaaatccagaaccaaatggaataccagcagagccgatgttgtactttcctatcaacaatccaacggcggctggccaaaaaatctcgattacaattcagtaagcgcaggtaatggcggcagcgatagcggcaccatcgataacggtgcaaccattactgaaatggtttatctcgcggaagtttacaaaaatggcaacaacaccaagtatcgcgatgcggtgcgcagagccgcaaattttattgtcagctcgcaatacagcactggtgcattaccacaattttatccattgaaaggcggctatgcagaccacgccacctttaacgataacggcatggcatatgcattaacggtattggattttgcagtcaacaaacgcgccccatttgatactgatgttttctccgattctgatcgcgcgaaattcaaaaccgctgttgccaaaggtgtggattacattttgaaagcgcagtggaaacaaaacggaaaattaaccgtgtggtgtgcacaacatggtgctaccgattatcaaccgaaaaaagcgcgcgcctatgaattggaatcactgagtggcagcgaatctgttggtgtactcgctttcttgatgacccaaccgcaaaccgcacaaattgaagccgctgtaaaagccggtgtagcctggttcaatagccccaacacgtatttgaacaattacacttacgactcttcaaaagcgtcaactaatccaatagttgccaagtctggaagcaaaatgtggtatcgcttttacgatttaaataccaatcgtggcttcttcagtgatcgcgatggcagcaaattctatgacatcacccagatgtcagaagagcgtcgcactggatatagctggggtggtgattacggcacgtcgattatttccttcgcgcaaaaagtgggatatctgtaa

SEQ ID NO: 2225 - protein, 407 aa, UNCULTURED BACTERIUM CLONE
MELPVTGAWATWQTATVEIDLVQGNNLLKLSAITADGLANIDSLKIDGAQTKAGVCSTVASSSSSSVASSIKSSSSSSSSSSTTTVKTLTLDGNPAANWFNKSRTKWNTSRADVVLSYQQSNGGWPKNLDYNSVSAGNGGSDSGTIDNGATITEMVYLAEVYKNGNNTKYRDAVRRAANFIVSSQYSTGALPQFYPLKGGYADHATFNDNGMAYALTVLDFAVNKRAPFDTDVFSDSDRAKFKTAVAKGVDYILKAQWKQNGKLTVWCAQHGATDYQPKKARAYELESLSGSESVGVLAFLMTQPQTAQIEAAVKAGVAWFNSPNTYLNNYTYDSSKASTNPIVAKSGSKMWYRFYDLNTNRGFFSDRDGSKFYDITQMSEERRTGYSWGGDYGTSIISFAQKVGYL

SEQ ID NO: 2226 - DNA, 1194 bp, UNCULTURED BACTERIUM CLONE
ttggtcgctgccctattaagctgcggcagcgccaatctctatgcagaatcaaccgcaaaatcggttacgcaatcagcagccacaaatcaattgcaaaatgaaaaaagcagttgggacagctattacgccgcatccaaaaaaatacatcaggcagaccaggattttctcgccgctgaattaaaaaaactcggtcagaaaaaaccaacattgcccgcacacaccaaagattttggttttgatgttaagcaggtaaatgcagattggtttaaaagtgacgaaggcaaacgtgtgatggagattattctctccttccaaaccccgtccggcggttggtcaaagcgtaccgacatggccaaggcggtgcgacaacctgggcaagcctttggcgttgaaaaaggctatatcccaacatttgataatggcgctaccagcactcaattgatgttgctcgcgcaagcacaccaagccaccggcgatcaccgctttagcgacgcatttgggcgcggcttgcaattaattttgactgcgcaatacccgaatggtggctggccacaaaactttccactaaccggtagctaccacgattacatcacctacaacgacaatcttacgcgcgacctgatggtagtgctgcacaaaacagcgcaggcaaaaaatgattttgcattcgtgaccaaagcgcagcaaatcgcagcgtcagctagcctcgcgcgtgcacttgattgcgtattgaaatcacaagttgtcgtcaatggcacacgcacactctggggcgcacagcacgatgttaaaacactgcaaccaaccaaagcgcgcgcatttgaaatggtgtcactcactaccactgaaagcgcagccatgctcagttttctgatggatatcaaaaatcccagcgcggatattattcaatccatacatgcagccatagcctggtatgagcaaaataaaatcgtcggaaaaacctggacacgtggtgatgcggaattaaaagataataaaaattcgcagccactctgggcgcgtttttatgagataggcactaataagcctatatttggggatcgcgatgacactgtgtattacgatttggcaaaagtgtctaaagagcgtcgcgaaggttatgcgtggtactccactgacccgaataagacgctaaaaaaatatgctgaatggtctaaaaaatatcccaaataa

SEQ ID NO: 2227 - protein, 397 aa, UNCULTURED BACTERIUM CLONE
MVAALLSCGSANLYAESTAKSVTQSAATNQLQNEKSSWDSYYAASKKIHQADQDFLAAELKKLGQKKPTLPAHTKDFGFDVKQVNADWFKSDEGKRVMEIILSFQTPSGGWSKRTDMAKAVRQPGQAFGVEKGYIPTFDNGATSTQLMLLAQAHQATGDHRFSDAFGRGLQLILTAQYPNGGWPQNFPLTGSYHDYITYNDNLTRDLMVVLHKTAQAKNDFAFVTKAQQIAASASLARALDCVLKSQVVVNGTRTLWGAQHDVKTLQPTKARAFEMVSLTTTESAAMLSFLMDIKNPSADIIQSIHAAIAWYEQNKIVGKTWTRGDAELKDNKNSQPLWARFYEIGTNKPIFGDRDDTVYYDLAKVSKERREGYAWYSTDPNKTLKKYAEWSKKYPK

SEQ ID NO: 2228 - DNA, 1221 bp, UNCULTURED BACTERIUM CLONE
atgctcaccaaaacatcactacttattgcattgctaggcagttgttgtatcgcaccattacatgcggacacaccagcaagcaatgcaccgacaaccaatgcatcaattccgctacagcaaactgcgagcgatgctgccgcctggaaaaattatctcgccaaatccaacgagttgcgcaaagcagaccaggcgcagctcaaagccgagctgaaaaaactcgggcaaaaaaccgcgagtttgcctgagtacaccaaagaatttggttttgaagtgaagcagtcatctgagtggtttaaaagcactgaaggtaaacgagtgatggatattatcctatcgtttcaaactccttctggcggctggtcaaaacgcactgacatgagcaaagcgccgcgcaaacccggccaggcatttggtgttgaaaaaaattacatccccacctttgataatggcgcgaccagcacacaattaatgctactggcacaggcgcatcaagccactggcgataaacgctacagcgatgcatttgcgcgcgggcttgaatttatcatcaccgctcaatatcccaatggcggctggccacaaaattttccattggttggcaagtatcacgatcacatcacttacaacgatgccctgatgcgcgatttaatggtagtgctacacaaggttgccatggccaaggatgaatttgcctttgtatccaaggcgcagcaacaggccgcacaagcgagcctcgaacgcgcgctggactgcgttttgaaaacccaggtgatggccaatggccaattaactatatggggtgcgcagcacgatgccaaaaccttaaaacccgccaaagcgcgcgcctatgaaatgatttcactcaccagttctgaaagcgtgtggatgctcgattttttaatggatttgcaacagcccagcgctgacattattaaatccgtgcacgcggctgccgcttggtatgagcaaaataaaattatcggaaaaacctggacccggggcgacacagttctgaaagacgataaggatgcaccgccaatctgggcgcgtttttatgagataggtacgaacaaacccctgtttggcgaccgcgatgactctgtccattacgatctggcaaaggtatcggaagagcgccgcacgggttatgcctggtacacaacctcacccaatcaggtattaaaaaagtacgcgcgctgggctaaacaatatccgcaataa

SEQ ID NO: 2229 - protein, 406 aa, UNCULTURED BACTERIUM CLONE
MLTKTSLLIALLGSCCIAPLHADTPASNAPTTNASIPLQQTASDAAAWKNYLAKSNELRKADQAQLKAELKKLGQKTASLPEYTKEFGFEVKQSSEWFKSTEGKRVMDIILSFQTPSGGWSKRTDMSKAPRKPGQAFGVEKNYIPTFDNGATSTQLMLLAQAHQATGDKRYSDAFARGLEFIITAQYPNGGWPQNFPLVGKYHDHITYNDALMRDLMVVLHKVAMAKDEFAFVSKAQQQAAQASLERALDCVLKTQVMANGQLTIWGAQHDAKTLKPAKARAYEMISLTSSESVWMLDFLMDLQQPSADIIKSVHAAAAWYEQNKIIGKTWTRGDTVLKDDKDAPPIWARFYEIGTNKPLFGDRDDSVHYDLAKVSEERRTGYAWYTTSPNQVLKKYARWAKQYPQ

SEQ ID NO: 2230 - DNA, 1182 bp, UNCULTURED BACTERIUM CLONE
atgaaccgtggcgtgattgttttgctggcggccgctccagctgcggcgcatggcgcagtgctggggtatatgacgcctgcgcagccgttgaccgaggcgcgcattgccgcgctgccggcgtcggagcagggcgcctggcggggctacctcgcccgctcccgcgcagccatggacgccgacaaggccgccctggccgccgagcgcgccgcgctcgccaccgtaccgccggcgccgccgcatggcggtggtgatggcgggatggcgcgcaaccgtccgacggcttggtatgggacgccggaagcgcggcacatcgcggacaatatcgtcagcttccagacgccgtccggcggctggggcaagaacgtggaccgcacgggacctgtgcgccagcgcggacagcattacgtttccttcgatggcaaggagtcctggaacttcatcggcacgatcgacaacaacgccacaacgagcgagctgaaattcctggcgcgcgtgcaggcgcaaatgcccggcgcggcgggcgacgaataccggaaggccgccctgcgcggcatcagctacctgttgaactcacaatatcccaacggcggcttcccgcaggtctatccgctgcaaggcggctaccacgacgccatcaccttcaacgacgatgccttcgccaacgtgctgcaagtgctgctggaagtggcgaaccgcaggggcgactatgccttcgtccccgaaaccgtggcaaccgatgcccgcgcggccgcggacaaggcgctccaagtcctgctggcgagccagatcatcgtcggcggcgtacgcaccgcctggtgccagcagcacgatgcgatcacgctggcgcccgtcggcgcccgcaatttcgaaccggccgcgctgaccagcacggaaagcgcgcgcctgctgatgctgttgatgctgctgcccgatccgagcccggagctgagagcgtcaatccatgcggggatggcctggctgcagaaagcggcgctgccgggggatgtctggtcgcgctactatgacctgaacacgatgaggccgatctttggggatcgtgaccgcagtatccacgatgatgtgaaggaattgagcgaggagaggcaaaaaggctatggctggttcagtaacggaccagccagagctaaacaggcttttgaggcctggacgcgcaaaccttga

SEQ ID NO: 2231 - protein, 393 aa, UNCULTURED BACTERIUM CLONE
MNRGVIVLLAAAPAAAHGAVLGYMTPAQPLTEARIAALPASEQGAWRGYLARSRAAMDADKAALAAERAALATVPPAPPHGGGDGGMARNRPTAWYGTPEARHIADNIVSFQTPSGGWGKNVDRTGPVRQRGQHYVSFDGKESWNFIGTIDNNATTSELKFLARVQAQMPGAAGDEYRKAALRGISYLLNSQYPNGGFPQVYPLQGGYHDAITFNDDAFANVLQVLLEVANRRGDYAFVPETVATDARAAADKALQVLLASQIIVGGVRTAWCQQHDAITLAPVGARNFEPAALTSTESARLLMLLMLLPDPSPELRASIHAGMAWLQKAALPGDVWSRYYDLNTMRPIFGDRDRSIHDDVKELSEERQKGYGWFSNGPARAKQAFEAWTRKP

SEQ ID NO: 2232 - DNA, 1269 bp, UNCULTURED BACTERIUM CLONE
atgcgtaaatcgaactgggccgtcacaacggccatcctgctcgcgctgagcgccgcaccgctggcggcaaagcccatcggacagatcaccctcgccgtgccgctcagcccggcgcgcctgaccgaaacgccgcctgagcagcgggcgcaatggcaggcctatctcgccaccaccgaggcacagcttaaggcagacaaggcggcgctggctgccgagcgcgccggtctggccgaaatccccgccaagccgaagaccggcagcgccaacaccatgccgctcgacaagccgctggaatggtacgcgtcgtccgaggcgcgtctggtcgccgataatatcgtcagctatcagactccggcaggcggctggggcaaaaatcaggcccgcaacgaacccacgcggttgaaaggtcaggcctacactatcgatgacgccgatcccaccggttcgggcaaatggaacttcgtcggcaccatcgacaacgacgccaccatcgtggaaattcgctttctcgcccgcgtagcggcggcggccacgggcccggaaggcgacgtctatcgcgcctccgccacgcgcggcatcacctacttgctggcggcgcagtaccccaatggcggctggccgcaggtctggccgcttcagggcggctatcacgacgccatcaccctcaatgacggcgcgatgatccatgtgctcgaactgtttgacgacatcgccagcggacagggcgacttcgccttcctgcctgagccgctgcgcgacaaggtcgaggccgcacaggcaaagggtcagaaggtgcttctcgatcttcagcttaagcgcaacggcgaacgcaccctgtgggcgcagcagtacgatccgattaccctcttgcccagcgcggcgcgtaactacgagccgtcgtcgatcagcaccggtgaaagcgccggtgtgctgatctacctcatgtccctgcccaacccctcgcctgaagtgcgcgacgccatcgaaaaaggcgtggccctgctgatcaaacttcagatcaacggcatggcatgggaaaaggacggcatgcgcaaacgtctggtcgccaaggctgacgcctcgccgctgtggtcgcgctatcacgactcggaaacgctgctgcccatcttcggtgaccgcgacatgcgcatcttcgacgacgtcaacgacatcagcgacgaacgcagccgcggctatgcctggtatggcacaagcccggcacgggccatcgccgaatacgaaaaatggaaacagggcaacggcaaatga

SEQ ID NO: 2233 - protein, 422 aa, UNCULTURED BACTERIUM CLONE
MRKSNWAVTTAILLALSAAPLAAKPIGQITLAVPLSPARLTETPPEQRAQWQAYLATTEAQLKADKAALAAERAGLAEIPAKPKTGSANTMPLDKPLEWYASSEARLVADNIVSYQTPAGGWGKNQARNEPTRLKGQAYTIDDADPTGSGKWNFVGTIDNDATIVEIRFLARVAAAATGPEGDVYRASATRGITYLLAAQYPNGGWPQVWPLQGGYHDAITLNDGAMIHVLELFDDIASGQGDFAFLPEPLRDKVEAAQAKGQKVLLDLQLKRNGERTLWAQQYDPITLLPSAARNYEPSSISTGESAGVLIYLMSLPNPSPEVRDAIEKGVALLIKLQINGMAWEKDGMRKRLVAKADASPLWSRYHDSETLLPIFGDRDMRIFDDVNDISDERSRGYAWYGTSPARAIAEYEKWKQGNGK

SEQ ID NO: 2234 - DNA, 1065 bp, UNCULTURED BACTERIUM CLONE
atgaaaacgatcagccttatttgcctcgcaatctctgctgggattctggattcggttgcggcggcacgctggaacgaattcgcccagaaggcggatgattggtatcgaggtgacgaaggcaggcgcgttgcttcgaatattctttctcaccaatcactgcaaggaagctggcccaagaataccgataccaccgcgagattcttcaatggagatctagcgaagattcagggcacgttcgacaacggtgcgacgacggacgagttgcgtttcctggcccgcgcgtttgtcgccacgaaagaaaaaaactacgagtcagcgttccgaaaaggcttcgaacacattctcgcggcgcaatacgcgaacggcggatggccgcaatattcgccgccgcccaaaagttaccaccgacacattaccttcaacgataattcgatggtgcggctgatgattttccttcgcgaggtcacgacttcgaatctctactcgttcgtcgaagcgccgctgcgaacacaagcccgcgaaagtttcgatcgcggtgtgcggtgcattcttaagtgccagatcgtcgtgaacgggcacaagaccgcgtggtgcgcgcaacatgatgaaacggatttcagcccccgatccgcgcgtagttacgaactgccttcgctgagcggttctgaatcagtcggcattgtgcgcttgctgatgagcctcgatcagccgagccgcggagtgatcgatgccatcaccaacgccgtagcgtggttcgaatcggcgaagctgcccgggatcaaaaccgttcaagagaccgatccgaattcgcccaaaggctggaatcgcgtcgtcgtaaaagatgaaagtgcccgaccgatgtgggcgcgtttctacgacatcaacaccaacaaaccgttcttttgtgatcgcgatggtgtgccaaagccgagtcttgccgagatcggttatgaacggcggaacggttatgcgtggctcggatactggcctgaagacttgctcgcaagagagtatccagcgtggaagatgaagtggctgaagcccaaagagcgcccagcattttga

SEQ ID NO: 2235 - protein, 354 aa, UNCULTURED BACTERIUM CLONE
MKTISLICLAISAGILDSVAAARWNEFAQKADDWYRGDEGRRVASNILSHQSLQGSWPKNTDTTARFFNGDLAKIQGTFDNGATTDELRFLARAFVATKEKNYESAFRKGFEHILAAQYANGGWPQYSPPPKSYHRHITFNDNSMVRLMIFLREVTTSNLYSFVEAPLRTQARESFDRGVRCILKCQIVVNGHKTAWCAQHDETDFSPRSARSYELPSLSGSESVGIVRLLMSLDQPSRGVIDAITNAVAWFESAKLPGIKTVQETDPNSPKGWNRVVVKDESARPMWARFYDINTNKPFFCDRDGVPKPSLAEIGYERRNGYAWLGYWPEDLLAREYPAWKMKWLKPKERPAF

SEQ ID NO: 2236 - DNA, 1038 bp, UNCULTURED BACTERIUM CLONE
gtgactcgtgtcgcccttgcgatggggcttgttgcatgggttccggcgctcgcttcagctgggcccgctgcatatttgcagaagccggacgactggttcgccagtcccgaggccagggcaatcgccgcgaacgtactcgcgcatcaggccgatctcggcgggtggccgaagaacatcgacacaacgaagccgttcaccggcgaccggacgcaaatcaaaccgaccttcgataacagcgcgacaaccgacgagctccggtttctggcgcgcatccacaacgcgactcgcgacgagaagtaccgcaccgcgttcgagaaggggctcgattacatcttgaaagcacaatacgcaaacggcggttggccgcagtcgcacccgcccggcaccggctaccaccggcacatcaccttcaacgacaatgccatggtccgtttgatggagctcgtgcgcgaagtcgcgacctcgaatcggtacgacttcctggacgccgaccgccgcaaggcctgccgcgccgctttcgatcgcggcatcgaatgcatcctgaagtgccagatcaaggtcgacagtaagctgacggcatggtgcgcccagcacgacgagaaggacctcgctccccggccggcgcggacctacgagctcgtctcactcagcggctcggagtcggtcgggatcgtccgcctactcatgagcctcgatcgaccaagcccggaggtcgctcgggccatcgacggcgcggtcgcgtggttccagtcggcgaagctcgaaggcaccaaggtcgttgtcgagcgcgacccgaagtatccgggcggccgggaacgcgtggtggtgaaggatccaaaggcaccgccactctgggcgcgcttctacgaaatcggcacgaatcgccccatcttctccgaccgcgacggcatcaagaagtacgcgctcgccgagatcggccccgaacggcggaatggctatgcctggtatggcacctggccgcgcgacctgctggagaaggaatacccagggtggaaaaagaagctggcccggccgtga

SEQ ID NO: 2237 - protein, 345 aa, UNCULTURED BACTERIUM CLONE
MTRVALAMGLVAWVPALASAGPAAYLQKPDDWFASPEARAIAANVLAHQADLGGWPKNIDTTKPFTGDRTQIKPTFDNSATTDELRFLARIHNATRDEKYRTAFEKGLDYILKAQYANGGWPQSHPPGTGYHRHITFNDNAMVRLMELVREVATSNRYDFLDADRRKACRAAFDRGIECILKCQIKVDSKLTAWCAQHDEKDLAPRPARTYELVSLSGSESVGIVRLLMSLDRPSPEVARAIDGAVAWFQSAKLEGTKVVVERDPKYPGGRERVVVKDPKAPPLWARFYEIGTNRPIFSDRDGIKKYALAEIGPERRNGYAWYGTWPRDLLEKEYPGWKKKLARP

SEQ ID NO: 2238 - DNA, 1035 bp, UNCULTURED BACTERIUM CLONE
atggcgcgtttgttccggtgcgtgtgtgccagcctgggaggatgggccgcggttctggccgccgcggcgggcccggattggtcccgcctgctcgcgcaaccggacccttggtttcgcagtccggcggggcaacaggcggtgacgaacgttttgtcctggcagagcgcgacaggcgcctggccgaaaaacctggacaccacccgcgagccgcgtcggcaggattccgccccgcccgagggcactttcgacaacggcgccaccaccggcgagttgcggtttctggcgcgggcgtttgcggccaccggcgatccgcgctgcgaagccgcggtgctccgggggctggacggcatcctcgcggcccagcttcccagcggcggctggccgcagtgtcatcctccgcgcgcgccttatcagcgccacatcaccttcaacgacggtgtcatggtgcgcatcctggagctgctgcgcgagatagaccgcgcgccggagtttcgctgggtggacgaggcgcggcgcgcgcgggtgcgcgcggccttcactcgcgggctggagtgcctcctgcgctgccaggtggtcgtcgagggcagactcaccgtgtggtgtgcccagcatgacgcggagaactttcaaccgcgaccggcacgcgcctacgaactggaatcgctcagcggcgcggaaagcgccggcatcctggtgttcctcatgagcctggagccgccaaccccggagatcgcgcgcgcggtcgaggccggggcggcctggttttcggcggtaaagcttgaagggttccgtctcgaacgaacggccgacgacgcgcgggtggtggaagagccgggcgcgccgccgctctgggcgcggttctacgagatcgggaccaatcgccccatctttgccggtcgcgacggtgtcaagaagtacgccctgagcgagatcgagcgggaacgccgggtcggctatgcgtggtacggcgcctggggtgaaccggtcgcccgccattatgcccagtggcgggagcgttacgggacgcagaaatga

SEQ ID NO: 2239 - protein, 344 aa, UNCULTURED BACTERIUM CLONE
MARLFRCVCASLGGWAAVLAAAAGPDWSRLLAQPDPWFRSPAGQQAVTNVLSWQSATGAWPKNLDTTREPRRQDSAPPEGTFDNGATTGELRFLARAFAATGDPRCEAAVLRGLDGILAAQLPSGGWPQCHPPRAPYQRHITFNDGVMVRILELLREIDRAPEFRWVDEARRARVRAAFTRGLECLLRCQVVVEGRLTVWCAQHDAENFQPRPARAYELESLSGAESAGILVFLMSLEPPTPEIARAVEAGAAWFSAVKLEGFRLERTADDARVVEEPGAPPLWARFYEIGTNRPIFAGRDGVKKYALSEIERERRVGYAWYGAWGEPVARHYAQWRERYGTQK

SEQ ID NO: 2240 - DNA, 1041 bp, UNCULTURED BACTERIUM CLONE
atgaaacttcgatgtctgatgctcaccctgcttctttgcggcagcgccttcgccgccgaccggattacggccgacaagatcaacaacaagcccgactcctggcttaccagcgacgaaggcatcaagctgatcgacaacatcatcacctggcagaaccccgagggtggctgggccaagtactacgacgcgaccaatccgcacaaacaaggcgaagtctacggcgactgggacggcgtcggcaccatcgacaacggctacacctacaccgagctgaatctcctggcgcacgtctacaccctcaccaagcgcccggagatcctcgattcgttcaacaagggcctggagtttctgctcaaagcccaataccccagcggcggctggccgcaacggtttccggtgcccaacaactacggcaagtgcatcacgctcaacgacaacgcgatggtgaacgtgatgcagttcctgcagaacgtcgcaaagggcaaggaagacttcgctttcgtcgacgagcagcgtcgcgccaaagcgaaggaggcgtttgaccgcgggatcgactgccttctgaagctccagattaccgtgaacggcaagcttaccgcctgggcccagcagtatgacccgaagacactcgccgcggcgcccgcccgggcgtacgagctcccgggcctcagcggctgcgaaagcgcgcccgtcatgcgcttgttcatgtctttggagaaccccagtcccgaagttcagcgcgccgtccacgcggcggcggcttggtacgaggcgtcgaagatcaccggcaagaagctggtgcgcgagaacaacgacgtgacactggccgacgaccccaacggcgagccgctttgggcgcgcttctacgacatcgaaaccaaccgcccgttctattgcggtcgcgacggcgtgaagaagtggtcgctggacgagatcgagcccgaacgccgcaagggctacgcttgggtccgcccctgggcgacgagcgtactggagcagtatcgcaagtgggcggcgaagcacccacccgtgaacagttga

SEQ ID NO: 2241 - protein, 346 aa, UNCULTURED BACTERIUM CLONE
MKLRCLMLTLLLCGSAFAADRITADKINNKPDSWLTSDEGIKLIDNIITWQNPEGGWAKYYDATNPHKQGEVYGDWDGVGTIDNGYTYTELNLLAHVYTLTKRPEILDSFNKGLEFLLKAQYPSGGWPQRFPVPNNYGKCITLNDNAMVNVMQFLQNVAKGKEDFAFVDEQRRAKAKEAFDRGIDCLLKLQITVNGKLTAWAQQYDPKTLAAAPARAYELPGLSGCESAPVMRLFMSLENPSPEVQRAVHAAAAWYEASKITGKKLVRENNDVTLADDPNGEPLWARFYDIETNRPFYCGRDGVKKWSLDEIEPERRKGYAWVRPWATSVLEQYRKWAAKHPPVNS

SEQ ID NO: 2242 - DNA, 1077 bp, UNCULTURED BACTERIUM CLONE
atgaaaaattttaaaaatattgtaggagcgttacttatatctgtaacgttttgtgtgcacgggcaggtaaacaaaaaatcctggcgggctattacacagtctaacgacgatgcatggtttgcatctgatggagctgcacagattgcagataatgtattactctatcagcgcaatgttggcggatggcctaaaaatattgaaatgcaggaaccgcttagtgaggccgacaaaaaaaagctgatagatcttaagtctacggccaaagaaagtactacagataatggggctacgtgtcaggaaatggtattcctctctaagatatataaacaaaagcccgaagagaagtataaagaggcttttttaaaaggacttaattatttgcttgaagcacagtataaaaatggtggatggccacagttctaccctttaaaaaaaggttattatacccacattacctataatgacgattctatggtaaacattcttatgatcttaaagaatattaaggaagatgccaactattacagtattacgccaagcgataaagttttaaagcaggtatcgacagcttttgacagaggcattgactgcattctaaaaacacagtacaagcaaaagggtgtgcttacaagctggtgtgcccagcacgatgaggttacattagaacctgcaaatgcaagggcttttgagttggcatcactaagtggtaaagaatctgctaaaataacgttgttgctaatgtctgtaaaaaatccgtctaaagaggttgttgctgctgtagatgctgctgtggcgtggtttgaaaaaacaaaaattgaaggcattaaagtagaagaagtaaccggagctgatggcaaaaaggatagggtagtagtacaaagggctgatgccgaaccattgtgggcgcgttttatggaactggataccaacaggccatttttttgcgacagggacggtataaaaaaatattcgcttgctgagataggtcatgaacgccgtaacggatatggctggtacaccaacgaaccaaaagaagttttaaagaaatacaccaaatggaaaaacagtcttaaatag

SEQ ID NO: 2243 - protein, 358 aa, UNCULTURED BACTERIUM CLONE
MKNFKNIVGALLISVTFCVHGQVNKKSWRAITQSNDDAWFASDGAAQIADNVLLYQRNVGGWPKNIEMQEPLSEADKKKLIDLKSTAKESTTDNGATCQEMVFLSKIYKQKPEEKYKEAFLKGLNYLLEAQYKNGGWPQFYPLKKGYYTHITYNDDSMVNILMILKNIKEDANYYSITPSDKVLKQVSTAFDRGIDCILKTQYKQKGVLTSWCAQHDEVTLEPANARAFELASLSGKESAKITLLLMSVKNPSKEVVAAVDAAVAWFEKTKIEGIKVEEVTGADGKKDRVVVQRADAEPLWARFMELDTNRPFFCDRDGIKKYSLAEIGHERRNGYGWYTNEPKEVLKKYTKWKNSLK

SEQ ID NO: 2244 - DNA, 1080 bp, UNCULTURED BACTERIUM CLONE
atgaaaaatttaaaatacagtttagtttcatttgtactactcattactatgaatgtttttacgcaagaaaaaaaagtaacttggaaaagcatcacagaaaataacgatgaaaattggtttgtaagcgaagaagccaaaaaaatagccgaaaatgttttgttatatcaacgcgatattggtggttggccaaaaaacactgaaattcaaaatgaactttcagaaaaagaaaaactaacattaaaagaattaaaatcggatccaaaaggatgtaccatcgacaatggtgcaacgtgtcaggaattacttttcttatccaaaatatataaatccaatccagatgagcgatataaaatggctttcttaaaaggtgtgatttacctgattacagctcaatacaaaaatggtggttggccacaatattaccctttgagagaaggatattacactcatattacttacaacgataatgcaatggtgaatgttttaaagttgttgaaagaagttaaagataaatctgattactactcaattcaagcacccgatgaaatttccaaaatggctgaagtatcatttaataaaggagtcgattgcatattaaaaacacagtacaaacaaaatggaatattaaccgcttggtgtgcacaacatgacagggaaacattgaaacctgctaaagcaagagcttatgaattgccttcgttaagcggaaaagaatcagccaaaattgtgttgttattaatgtcaatcgaaaatccatctaaagaagtaattactgccgtaaattcagcagttaattggtttgaaaaaacaaaaatcaacggaattaaaattgaaaccatttccaccgggaaaaaggatgaaaaagatagaattgttgttgaaagtcctgatgctccgccgctttgggcaagatttatggaattaagtgacaacaaaccatttttttgtgatcgtgacggaaagaaaaaatacagcatgtcagaaattagtcaagagcgtagaaccggctatgcatggtacaccaacgaaccaaaagaagttttaaaaaaatacgatgattggaagtcatcattaaactaa

SEQ ID NO: 2245 - protein, 359 aa, UNCULTURED BACTERIUM CLONE
MKNLKYSLVSFVLLITMNVFTQEKKVTWKSITENNDENWFVSEEAKKIAENVLLYQRDIGGWPKNTEIQNELSEKEKLTLKELKSDPKGCTIDNGATCQELLFLSKIYKSNPDERYKMAFLKGVIYLITAQYKNGGWPQYYPLREGYYTHITYNDNAMVNVLKLLKEVKDKSDYYSIQAPDEISKMAEVSFNKGVDCILKTQYKQNGILTAWCAQHDRETLKPAKARAYELPSLSGKESAKIVLLLMSIENPSKEVITAVNSAVNWFEKTKINGIKIETISTGKKDEKDRIVVESPDAPPLWARFMELSDNKPFFCDRDGKKKYSMSEISQERRTGYAWYTNEPKEVLKKYDDWKSSLN

SEQ ID NO: 2246 - DNA, 1125 bp, UNCULTURED BACTERIUM CLONE
gtggtcctaggtaataacggcggcagcttgagttgcgtccaatatattgtgattgtgaaaggacccggtggacctcgaccgccggtgaaaccggccgtccaggcgcccgttagggttacctggagcgcatgcctagtccagcggcccgaatggtacgggagtgacgaagcgatccgcatcgcggacaacgtcctcctctaccagcgcaacaccggcgggtggccgaaggacatagatatggccgagcccatcccggaacacaggaagtcctttttcctcaccgagaaggagcggaccgatgactcgaccatcgacaacggtgccaccgtgacccagctcaagtatctcgcccgcgtctacaaggcgaccaggctggaacggttcaaggagggcttcctcaaaggtctcgactacctcttggccgcccagtacccgaacggcggctggccccagtattatcctaacttgaggggctactacgccaacatcacttataacgacaatgccatggtgaacgtgctcaccctcctccagagcatcgccaaaaaggccccggagtacgacttcgtcgacccggcgcgccgggagaaggccgcccgggccgtggcgaaagggatcgactgcatcctcaagacccagatccgtgtcaatggaaaacttaccgcctggtgcgcccagcatgaccccaagacgctggcgcccgcgccggcccgttcgtatgagcttgagtccatcagcggtttcgagagcgtcgggatcgtccggttcttaatgagcctcgagaatccgagcccgaaggtcatcgaggcggtagaggccgccgtgaaatggttcgaggaggtcaagcttaccgggatcaaggtggtcgagaaacccgacccgtcccttccgggcggttacgaccgcgtggtggtcgaagaccccaacgcgccgcccatctgggcccggttctacgagatcggcaccaaccgtcccttcttctgcggccgcgatggtatcaaaaaatacagcctggcggagatcgaacacgaacgccgggtcggttactcctggtacaccaatgccccggcctacctcatcgagaaggagtatccgctctggcgggccaaacaccctaccaagtaa

SEQ ID NO: 2247 - protein, 374 aa, UNCULTURED BACTERIUM CLONE
MVLGNNGGSLSCVQYIVIVKGPGGPRPPVKPAVQAPVRVTWSACLVQRPEWYGSDEAIRIADNVLLYQRNTGGWPKDIDMAEPIPEHRKSFFLTEKERTDDSTIDNGATVTQLKYLARVYKATRLERFKEGFLKGLDYLLAAQYPNGGWPQYYPNLRGYYANITYNDNAMVNVLTLLQSIAKKAPEYDFVDPARREKAARAVAKGIDCILKTQIRVNGKLTAWCAQHDPKTLAPAPARSYELESISGFESVGIVRFLMSLENPSPKVIEAVEAAVKWFEEVKLTGIKVVEKPDPSLPGGYDRVVVEDPNAPPIWARFYEIGTNRPFFCGRDGIKKYSLAEIEHERRVGYSWYTNAPAYLIEKEYPLWRAKHPTK

SEQ ID NO: 2248 - DNA, 147 bp, Aspergillus niger
atgaagtactctactatcttcagcgctgctgccgctgttttcgctggttccgccgctgcagtcggcgtgtccggctctgctgagggtttcgcggagggcgtcaccggtggcggtgatgccacccccgtctaccccgacactatcgat

SEQ ID NO: 2249 - protein, 49 aa, Aspergillus niger
MKYSTIFSAAAAVFAGSAAAVGVSGSAEGFAEGVTGGGDATPVYPDTID

SEQ ID NO: 2250 - DNA, 3167 bp, Aspergillus niger
gaattcgaatctggaggacattacgtgtgcctgacttcgggctacttctgtcttcactgtagccaggcactatccctgacactctgccccctacgtggtcttacctttatcggatttagatagtaaccaatctgatcccacatcctgatacctggatacttttccccatggcatcgtgtaatctatgatactcaaaggaacaaagcagatacttgaagctgcaagaccttgtctcagagatcgcagctttgttgtttagaaacacagtctgtcaccggttcgccagattaagtgttaaacatgtgacaggcacctaaaagctgacagcctcggcctgagctcgtagagtaccctcttctaggtctttgtgggttgactgcaagcaaaggatcaagcttgtcggagaatttggagcttttgcatgtaatttttccgactggggtccgagtatttcccgcggtgtatgttagaatggttagtatggatagattggtagaaaagttgacctgaaacattgagatatctgattagtagtatgctatagatctggatatacatttctgcaatgaaatgtgatcatatgaactttttgaaatgaaggagatatatgcatagttgtgaaatatgcgcgtggcctgtccgttctcagccctgacgggtgacatcccgttcggctgtttagtggaaagccgcgtggctgtctcgggggagtgggtcagggtcctccaggaattttcttttctaggttagttcttccagccttccagggtcctgcagacccgcctccaaacagctgattgtggtgtaaccgtttacaagactggccaggatatttttgtatatgtcactatcgtgaagattatattcatcttatatcaattggagcttgaggtctatctcttagtgtgcgcacaaaaagccgatatgattcaatgcgtctgtcaaataacccgaactgtccgaatcatcacacccacagagtgctgcgaaggtcgtgatccttccaagtatctcagaaaagaccactacactggacccccaacaaaggtacacaataacttcgggtagagaattgtgcgatgcagagcatagtatatctgaaacaactgtcactgcagacctttcctacttgtgcatccggttcgcattgcagtggggcagggcagttcttggccgaagaactatgatcactttgtaacaacggtggcccctgtagctaccagtgttctgtacttcggcaaaattcaatccttggcttctatatgtcactaggtgactttgaatacataaagatgaaatgttggaactttggacgatacctctgtctgtcaacacaatctgtacttttccaaaacccttatccattatgaaggtccccttcctccaacttctctgcctaaatgccgccttggctagtgccaatgttgttcaaggtgctgcccagggtttcgcagccggcgtcactggcggcggcgatataactcccagctaccccaaaaccaacgaggagcttgtctccctgctcgagagtgacgaaccccaagtcgtcgtactcaccaagacctttgatttcatcggtaccgagggaaccacgaccgaggatggatgcgcgccctggggtactgggaagtcctgccagctggccatcaactccaatggatggtgtggtaaaaatcccgtcgtaaccatcacgtatgataacgccgccaagaatggcattcatatcaagtccaacaagactcttgttggtgagggagacaagggcgtgctcagcggaaagggtctctactttgagggtggtgtttccaatatcatcgtgcagaacattaagattacgaacctcaaccctgggtatgtatcatcccagtaactaggagttctcgaatgctttgggagacacaccatgtgttctaacgtctttcactacagttttgtctggggtggcgacgcgtttactttctttggcgctgacctgatctggatcgaccactgcgaggtaagacagaaatctccatcatctgataatcatgattgagtttctcacgttgacttatggattagacctccctcaccggacgccaacactacgtgaccggcttccaccccaacacccgcatgacttggtccaataacttccttaacggcgtaaccacccactccgcaggctgtgatgaccaccactactggacaatggagctagttggccctggggacgagattaccttccagagtacgtgtcccatgaaaacctaaaagaagcatctattcaactaacatacgtgttcactcacagacaactacgtctaccacaccaccggccgtggacccgctctctccggcacgaccctcttccacgcagtcaacagcgtctggtcttccatccccggacacgccatcgagggcggtgacaagggccgcggtcttttcgagggatgcttcttcgaagatgttgtcgagatcgcccccgccaagcccgagaaccaactcttcagcgccagtgaagccaacgccgcatcttgcaagtccgccttgggacgcgcttgccaggccaatggctatagcaaatctggtgcttttggcagttctgaaactggctttttcaaggactttgccggactgactattgcaccggccggctctgcgaccgacgctctcgcttatgttcctaagaattgtggtattgggcgtcttgaaagctgcgatgcttagggtggagcttgttgagtctatatttgaccaatagggtgtactttattctacttcagtccggttaatatatgtaatatatttggattctgcgcgcaacttgtgctttcctcagttctgcaatatccattcaagtagtctacgcatctctatagactattgatcaatataacatagcagacaacactgccaaccaaaatataagacccagtatatactttccgtgaagtatttaaaacagattacatctagcttgaaaatcatccctctctggttcaagtattcacgtcagtagctgaaaagggaataacgatgaccgcgaataatttgacaatcatctacccgatgaataccaatcaaggaaaacaaaagtcgtgagaaaaatgcaagggagaaagttatatgttacaaaagaaacatacaacagaaggaatatgtcagtggtcattgaacattacaaa

SEQ ID NO: 2251 - protein, 378 aa, Aspergillus niger
MKVPFLQLLCLNAALASANVVQGAAQGFAAGVTGGGDITPSYPKTNEELVSLLESDEPQVVVLTKTFDFIGTEGTTTEDGCAPWGTGKSCQLAINSNGWCGKNPVVTITYDNAAKNGIHIKSNKTLVGEGDKGVLSGKGLYFEGGVSNIIVQNIKITNLNPGFVWGGDAFTFFGADLIWIDHCETSLTGRQHYVTGFHPNTRMTWSNNFLNGVTTHSAGCDDHHYWTMELVGPGDEITFQNNYVYHTTGRGPALSGTTLFHAVNSVWSSIPGHAIEGGDKGRGLFEGCFFEDVVEIAPAKPENQLFSASEANAASCKSALGRACQANGYSKSGAFGSSETGFFKDFAGLTIAPAGSATDALAYVPKNCGIGRLESCDA

SEQ ID NO: 2252 - DNA, 2633 bp, Penicillium expansum
cagtgttcgccaagacggacaaactctcccaaacccctaccccttgaccaccttgcctcacactggagaaatcaaaaatcaacacagaccatggatcttgcaacaaaaaggagggagatactccaaatggacctcggagactgttctcatccgagtaaagtgtccggccacaatgctgacaagcttactccatgcagcgaccgatgtggggaacatcccccaagtgaaacatcttcaagcaccggacccaattcttcaatgccggtttgatttacgactaggattactcaactttaactcctgagtttcctttgaatattgcatttgcgccacaggatgcccttgtatacgaatatccgaatatacgaatatgagcactatccaacgggccccccctattggtgtactatcatgtcccacaacacgggtctacaattcttccgcatccttctcacctactttgtacccctgcatagcatggccatatatttctccgccaaattgtggatcatgcacaaccttaatacattgccagactgtccaaggttggtcccacgtttatgccaagccccaggcgcctagggcttcggtcaccattcgccggaacaacatcggcataccataacggagattacccgggtggagagacatgattctcaaacaagcttgtgtcttagcccggattatccgggagagctatctatactggactacttgttgatcctatataaggtcacgtccatcgcgcccaaatctctctttcagctctccatcccaaccattacattcttttatacaggtagaaactaccaactcccaacatgaagatcgccgctatctttgcagcactcgctgtgcgagctgccgccgtcggtgtcaccggcgccgcagagggtttcgccaagggcgtcactggtggtggctctgccacccctgtctaccccagcaccacagccgagctggtctcgtacctgggtgactcttcccctcgtgtcattattctcaccaagaccttcgacttcaccggtactgagggaactacctccgccactggctgcgctctcttgggggtactgcctccgcttgtcaggttgccatcaaccagaaacaactggtgccagaactacgagcctaacgcgccctccacctctgtcaatacgacaacgccccggtgttctcggcataaccgtcaagtccaacaagtccatcgttggctccggcagcgccccggtgtcatcaagggcagtatgtgtatcgtaagcggcgcgaacaacgcatcatccagtaagatattaaccaccctgctaaccccaaaaaaccgattaattaaacccattccaccccaggaacgtcggccatcacccgaaccatcaaaaccccaaagtacgttttggggcgggtgacgcccatcacccatccaacaacggccggacatgatctggatcgaatcacggtaaccacccgcccgtatctctcgccagcacatcggtgctcggcaccgagggcctccaagcgtgtcactatctccaacagcttcatcaacggtgccagcgactactccgccacctgcaacggataccactactggggtgtctaccttgatggatccagcgatctcgttaccatgaagggcaaccaacaatctaccacaccaagtgacgtgcccccaaggttcagggcaacaccccttctccacgcttgtaagtgaaacaaacacccgaccaacagtcatttttaatttccagatgacaaaccactttctcgggattacctcaaatcccctctttttggaaatataactaatacataacgctaggtcaacaacttactggttccagaactcccggccacgccttcgagatcgggcgctggtggctacgtccctcgctgagggtaacgtgttccagaacattgttgcttctgtcgagactcctattgctggacagttgttctcctcccccgatagcaccaccaacgctgtctgcagctctcacctcggccgtgcctgccagctcaatggattcggatcttccggaaccttcgatggccgtgctgatactgcattcttggccaactttgctggaaagaacattgcttctgcttccgcttacacttccgttgttgccagtgttaacgctaacgctggtcagggtaagcctttgaagtggagttgagtgtgatttactcgtgcggagggaagttgtgaggtgacgaggggaaggttgggagagggagaggtagttggcgattgtcgtgtattaatttaaacaataaagatctctatgtgttctattagcattaataggaaatcatttgatttattgagaagagtaacaagactagaactagttcgagttggcgagatggacaacttgtgctcaagtcatagggctaatgatagcgatgtgcgtatgcggtgatctgccagaggcggctgaggatgcagttcaactacttgatgatgaaaagaccaggccggcgacagtttcattcgccaccccgtacgcatttgtgaacggtccctcggatatgtcactgcagcaatggtcaacccgttcatttggatgtgcctctaagggaacaaagcctttgcagtaattgtgttggtttctccttgggcgatgaatgtggaa

SEQ ID NO: 2253 - protein, 374 aa, Penicillium expansum
MKIAAIFAALAVRAAAVGVTGAAEGFAKGVTGGGSATPVYPSTTAELVSYLGDSSPRVIILTKTFDFTGTEGTTSATGCALLGVLPPLVRLPSTRNNWCQNYEPNAPSTSVNTTTPRCSRHNRQVQQVHRWLRQRPGVIKGRTSAITRTIKTPKYVLGRVTPITHPTTAGHDLDRITVTTRPYLSPAHRCSAPRASKRVTISNSFINGASDYSATCNGYHYWGVYLDGSSDLVTMKGNQQSTTPSDVPPRFRATPLLHACQQLTGSRTPGHAFEIGRWWLRPSLRVTCSRTLLLLSRLLLLDSCSPPPIAPPTLSAALTSAVPASSMDSDLPEPSMAVLILHSWPTLLERTLLLLPLTLPLLPVLTLTLVRVSL

SEQ ID NO: 2254 - DNA, 254 bp, Blumeria graminis
ccatatcaccgagcttaaccctcagtacatttggggcggtgatgccattaacctggatggcaccgacaacatttggattgaccatgtcaaggtttccctggttggtcgccagatgtttgtttccggttacgagtcaagtcagtaacaaacaccctcctgatcatgctctgttctcaattgaccgatttttcacaggtggcagcgtcactatttccaactctgagttcgatggtcgcaccagttggtctgcttct

SEQ ID NO: 2255 - DNA, 2395 bp, Aspergillus oryzae
aagcttaaaaatcaatcccgagtcatctctactactcttttgtcaattgatggatcatcccagagtggaaattgcatggttccattaggcttttacatatgcttggttggggcggatgtggaccagccctaaatgggacctcacggcagcgaaattctccgactatatccacgatcatcgcaagacttaactctctgtgacccagatcgctggtgattccccgtaaatatgttcctctaccactgtgccatgacagaaaccctctaaatgcctcacccgcaagaattgatcgtgatattccaccaccaggagaagaaatcaaggtataaagatgactaattttttatttactagtgttggagcggccgcgtcatgcagtttcccctatcggacaacgtaggattccaccaataaagcagcgcaatatgtgctaaagaaatacccatctacttgaaacgaccatatccagcagtgagagtaccaatgccgaaccgacattttcccggctggccgtggtggaattgtttcacagatgctgacgatcacctacccaaaccaatatagactccggagggatcggcaagggcttcaccatgtacagtagccggtccattccgacaacgattcgttcatctatccctcttcctggctatggaggctgttcgagattaaccctctatacccccacctactatgggactccctaacaaggccgaaacaactacggtgctggagaaaatcagctataagaatgagttctgctggtcttaaaggcctgttgttctccttctcaacgcacgcaatctcacttctgtcattctttgctttcttttgtctctgttctagtcactctttccttaataccatctcaaacctcaacaaaagacttccaggatgaagtacgccgctgttcttacgaccgttgccgccctcgcctctcgggccttgggcgctggtgtctctggcaccgcggaggcgttcgcatctagcgctactggtggtggcagtgccaccgccgtctaccccactaccaccgatgagctggtctcctacctcggtgacgatgaggcccgtgtgattgttctgagccagactttcgacttcaccaacactgagggtaccaccacggagactggttgcgctccttggggaactggctccgcgtgccaggtggccatcaacaaggatgactggtgcaccaactacgagtccagcgctccctccacctctgtgacctagtaagtgtgctacaagcacgagattaggcattagcgtctccctaacacgcactagcgataacgccggttctcttggtatcactgtcaactccaacaagtccctgatcggcgagggcaccaaaggtgtcatcaagggcaagggtctccgtatcgtcaacggtgtcgagaacgtcattatccagtacgttggcagccatggtgttcttaattggatggagaacagatattgactgtttccaggaacattgctgtcaccgatatcaaccccaagtacgtctggggtggtgacgccatcactatcaaccaggccgatcttgtctggatcgaccatgtgaccgtatgctttccagctatcgaatgatttgcgtcgacaggaacacaataactgacaaatctcacagactgctcgcattggtcgccagcactacgtcctcggaaccgaggctgacaaccgcgtcaccctctccaacaactacatcgatggagagtctgactactcggccacctgcgacggccaccactactggaatgtctacctggacggctccagcgacaaggttactatgaagggtaactacttctacaagaccagtggccgtgctcctaaggtccagggcaacacctacctgcacgctgtcaacaactactggaacgacaactccaaccacgccttcgagatcggctccggtggttacgtccttgctgagggtaacaccttcgccgacgtcaccgccgccgtcgaggactcctccttcgagggtgagctcttctcctcctcacgcgatgccgacacctgcagctcctacatcggccgcgcttgcaaggccaactcgttcactaactcgggtgacctctccggcaccaccgtcgacgttctctccaagttcaagggtgagaccgttgccaccgctgacaccgccagcactgcccctgcctccaatgctggtcagggtaacctgtagatggaaacatttgcgaggttccatactcttccaagacgttagtcgcttgaagtcgaagtggcagtgatcgtgttacacagcaagggctctatgtattttactgtgtagattaatgtctatcttcgcttaatttatattattcttgagatacggagtagctgaatcggtagtatttcttttcactgagcggtcaac

SEQ ID NO: 2256 - protein, 375 aa, Aspergillus oryzae
MKYAAVLTTVAALASRALGAGVSGTAEAFASSATGGGSATAVYPTTTDELVSYLGDDEARVIVLSQTFDFTNTEGTTTETGCAPWGTGSACQVAINKDDWCTNYESSAPSTSVTYDNAGSLGITVNSNKSLIGEGTKGVIKGKGLRIVNGVENVIIQNIAVTDINPKYVWGGDAITINQADLVWIDHVTTARIGRQHYVLGTEADNRVTLSNNYIDGESDYSATCDGHHYWNVYLDGSSDKVTMKGNYFYKTSGRAPKVQGNTYLHAVNNYWNDNSNHAFEIGSGGYVLAEGNTFADVTAAVEDSSFEGELFSSSRDADTCSSYIGRACKANSFTNSGDLSGTTVDVLSKFKGETVATADTASTAPASNAGQGNL

SEQ ID NO: 2257 - DNA, 2068 bp, Aspergillus oryzae
agatctccggctgccaaaatcaaatgccaagacggagaaattgctccataattactattctgcttcgtccggaactaaaagttttagactaccgaactaagaaagccgaagtggcaatcgtgaaacactatccatgacccttaactcctcctccaccaaatagcttcaagggccattattggccaccttggtcggcgtatctcagaatctccattcaggggaacatggttaaggcttaagcatctgcgggagttcgtgcctttacttctcgcccgccaataaccctacaggcttccgattcagtctgtaacggattgataaaggagtggagccctgatacttccctggtcctccggtgggcagaatgggtctcttgatataagattactcaggcgtttgtgccccagcagacttagacaaggttttaccttgcagcaccggcctggcgtttgctggacgtttcatctctcgtctccccttagtcccattctagaacataatttgaccaaaaggatgatgcctttcgcagctccaccgagtaattgagctcctacatataaagctagggaccttcgctctcatggtccggagtatcaatccattccttctttatcacctacttttagtccttcctttcttttcatttgtctttctttcaaacatgaagtacgcgtctttcatcgccgctgctgcggctgcgctcgccagcgccgttacggccgccggcgtttctggttctgctgagggtttcgccaagggcgtcactggtggtggcagcgctacccccgtttacccatccaccaccgatgagctggtctcatacctcggtgacagcgaggcgcgtgttatcattctcaccaagaccttcgacttcacaaacactgagggcaccgagactagctcgggttgtgctccctggggtactgcctccggctgccagcttgccatcaacaaggataactggtgcaccaactacgagcccaacgctccgaccgtgagcagcatcacctacaacaaggctggtgttctcggtatcaccgtcaactccaacaagtccatcgtcggccagggcagtgccggtgtcatcaagggccgtggtctccgtatcgtcagcggtgccaagaacgtcattatccagtgagtatttccggatctctattcgtctagagccgatactaatcgcaacacagaaacattgctatcactgacatcaaccccaagtatgtctggggtggtgatgccatcactctgaacgaggccgaccttgtctggatcgatcatgttaccactgcccgtatcgcccgtcagcacatcgtcctcggtacccaggccgacaaccgtgtcaccatctccaactccctcatcgacggtcgcaccgactactccgctacctgcaacggccaccactactggggtgtttaccttgacggctccaacgacatggtcaccatgatgggtaactacttctactacacctccggccgtatgcccaaggtccagggcaacaccctcctccacgccgtcaacaactacttccacaatattgagggccacgccttcgagatcggctccggtggctacgtcctcgccgagggtaacgctttccagaacgtcgatgcccctgttgagtcccccatcagcggacagctcttcagcgcccccgatgccaccaccaacgagcagtgcaagtccgtcttcggccgtgcttgccagatcaacgccttcggcagctccggttccttcagccaggctgataccgccgtcatctctaagttctctggcaagaacatcgctacagctcaccttgctcagaacatccccaagtgggttatggtcaacgctggccagggcaagctctaaatcatagagtgagaggtttctgtataaacagtgggtgtgggtgagaacggtgggggtctcagggtcgatatttaatcttcgtgtatctacttctttttaatactttagcaagctacaatattattaatttagcttgaactttcgcgttggttcatgatttgtagaaatgtgcggcatcacccatgaggaactatcgtgctgagtatac

SEQ ID NO: 2258 - protein, 381 aa, Aspergillus oryzae
MKYASFIAAAAAALASAVTAAGVSGSAEGFAKGVTGGGSATPVYPSTTDELVSYLGDSEARVIILTKTFDFTNTEGTETSSGCAPWGTASGCQLAINKDNWCTNYEPNAPTVSSITYNKAGVLGITVNSNKSIVGQGSAGVIKGRGLRIVSGAKNVIIQNIAITDINPKYVWGGDAITLNEADLVWIDHVTTARIARQHIVLGTQADNRVTISNSLIDGRTDYSATCNGHHYWGVYLDGSNDMVTMMGNYFYYTSGRMPKVQGNTLLHAVNNYFHNIEGHAFEIGSGGYVLAEGNAFQNVDAPVESPISGQLFSAPDATTNEQCKSVFGRACQINAFGSSGSFSQADTAVISKFSGKNIATAHLAQNIPKWVMVNAGQGKL

SEQ ID NO: 2259 - DNA, 1718 bp, COLLETOTRICHUM GLOEOSPORIOIDES
cagtagtctctctttcccacttgatttccattgcttgtactccgtcttttggattccggaactccaatcggccgcaacgattccttgcttgtcattctttcatctctactttctttaggctccatttccaaccatttcgaacccacaatgaagtcggcttcagccatcttggcggtcttggcaggccttgtcaacatcgcggccgcccaggccgtctccggtaaggctgagggtttcgccgccggtgttaccggaggaggcagcgcgaccgcggtcacgcccaaggacatcaaggagctcaccacctacctgacggacgacgagcctcgcgtcattctcttggacaaggagtacgactacaccacgtccgaaggcaccgagtctggcaatgtctgcgctagctggggaacaggcaacgcctgccagaagatcatcctggacacctgcgacagcaagagcccagcttccaaagagacttggaacaaggccgctcgtcaacccatcgacgtcggaaacaacaagaccatcctcggcgtcggcagcaagggcgccatcaagggcaaggggctgagaatgaggggcagcaacgtcattatccagaacattgaagtctccgacctgaaccacaagtacgtttggggtggtgatgccattggctttgacggtgcggacctcgtctgggtcgaccacgtcacgaccgctcgtcccggccgccagcactacgtcttcggcttcaaccccagcaagcgcatcaccctgtccaacaacttcatcaacggcgagtccacctactccaccggctgcaacggctaccactactggacctttgagatggtcggcaaggacgaccagatcaccatgaagaacaactacatctacaagaccaccggccgtggacccgcgctgagtggcggcactctccttcacgcagtcaacaacgtctgggaagacatcaacggccacgccctcgagggaggtgacgcgaacgcccgcggcatcttcgagggcaacgccttcatcaaggtctcgcagctggtctccgactacaagggcaggctcttcagctcccccgatgccaccaccaacgcccagtgcaagaccgccctcggcagagcctgcgaggtcaacgtcctcgaggacaccaccgacgccttcaagtacaccgacacctccttctttggcgacttcaagggcctctccatcgccagcgccgacgccgccagcaagatcaagaccagcgtccccgccaacgccggtgccggcaagttgagctccggctccggctccggctccggtcccggctcgtacggctcgtccaacaccaccgagcctgtcgccgcgaccagcgccgcgccctccgccgtcgtctccgaggccgccgaagaagagaagcccgcttacgcccccgccacttctgctgctgccgctgctcagccgaccaagcccgctaccggctccggttctggttctggttctggttctgttgcgctctacggccagtgcggtggtcagggatactctggcgccaccacctgtgcctctggcaagtgtgagctcgtcaacgactggtactcccagtgtgtctaagtcaccacccatcaacatcttctgcggccaggcagagaaaccgaccttcttgtaactgtcttctatacctatattcccttgtaaataccttaatggcctggggctccgtagaaaaccaagcgtcttgcatc

SEQ ID NO: 2260 - protein, 479 aa, COLLETOTRICHUM GLOEOSPORIOIDES
MKSASAILAVLAGLVNIAAAQAVSGKAEGFAAGVTGGGSATAVTPKDIKELTTYLTDDEPRVILLDKEYDYTTSEGTESGNVCASWGTGNACQKIILDTCDSKSPASKETWNKAARQPIDVGNNKTILGVGSKGAIKGKGLRMRGSNVIIQNIEVSDLNHKYVWGGDAIGFDGADLVWVDHVTTARPGRQHYVFGFNPSKRITLSNNFINGESTYSTGCNGYHYWTFEMVGKDDQITMKNNYIYKTTGRGPALSGGTLLHAVNNVWEDINGHALEGGDANARGIFEGNAFIKVSQLVSDYKGRLFSSPDATTNAQCKTALGRACEVNVLEDTTDAFKYTDTSFFGDFKGLSIASADAASKIKTSVPANAGAGKLSSGSGSGSGPGSYGSSNTTEPVAATSAAPSAVVSEAAEEEKPAYAPATSAAAAAQPTKPATGSGSGSGSGSVALYGQCGGQGYSGATTCASGKCELVNDWYSQCV

SEQ ID NO: 2261 - DNA, 1414 bp, COLLETOTRICHUM GLOEOSPORIOIDES
tctttttcttcaaacacacacacacaccgacctctacattcgttcttttgtcaactatttttcatcttctcttaacgaaagctttccccaaacatgaagtctaccatcatctccgcggcactggctgccctggtccctttcgtctcggccgctgatgccgtcaagggcgccgccgaaggctttgccaagggcgtcaccggtggtggcagcgcctctcccgtctaccctaccaccaacgccgagctcacctcctatctgaaggactcctccgcccgcgtcatcgtcctcaccaagacgttcgacttcaccggaaccgagggaaccgcctccgagactggatgtgccccctacggcactggctctgcttgccaggttgccatcaacaaggacaactggtgcaccaactaccagcccaacgcccccaaggtctctgtcaagtacgacaaggccgccttcagcccccttatcgttggaagcaacaagtccctcatcggccagggctccaagggtgtcatcaagggcaagggtatccgcatcaccaacagcgccaagaacgtcattgtccagaacattcacatcacccagctcaacccccagtacgtctggggtggtgacgccgtctccctggacggctccgacttggtctggatcgaccacgtcaagacgtccctgatcggccgccagcacatcgtcctcggcaacggcgccaacaaccgcgtcaccatctccaacaacgagattgacggctccacctcgtggtccgccacctgcgacaaccaccactactggggcgtctacctcaccggcagcaacgacatggtcaccttcaagagcaactacatccaccacacctccggaagagcccccaagatcgccggcaactccctcgtccacgtcgtcaacaactacttttacgacaacaccggccacgccatggaggccgacgccggcgcccaggtcgtcctcgagggcaacatcttccagaacgtaaaggccgccatgcagtccggcctcgccggcaaggtcttctcctcccccgacagcaacaccaacaaggtctgctccgccaacctcggccacgcctgccagctcaacgcctacggcagctccggctccctcaccggctccgactcgagcttcctcggcaactttgccggcaagaacattgcttccgcgggtacctccaacgacgccaagacggcccagaccagcgccggtttcggcaagatctaagctgcgcttggtcctgtggggcttctcctttttgaacgggattcaatgttactttggagagcgtggtggtggtgtgtggttgagagggaagttgagtcgaggcacgcgagtgaccgacgactgattcatgtacataccttacttaccgtcgaggacgtaaatacaatgcttgatgcatctt

SEQ ID NO: 2262 - protein, 379 aa, COLLETOTRICHUM GLOEOSPORIOIDES
MKSTIISAALAALVPFVSAADAVKGAAEGFAKGVTGGGSASPVYPTTNAELTSYLKDSSARVIVLTKTFDFTGTEGTASETGCAPYGTGSACQVAINKDNWCTNYQPNAPKVSVKYDKAAFSPLIVGSNKSLIGQGSKGVIKGKGIRITNSAKNVIVQNIHITQLNPQYVWGGDAVSLDGSDLVWIDHVKTSLIGRQHIVLGNGANNRVTISNNEIDGSTSWSATCDNHHYWGVYLTGSNDMVTFKSNYIHHTSGRAPKIAGNSLVHVVNNYFYDNTGHAMEADAGAQVVLEGNIFQNVKAAMQSGLAGKVFSSPDSNTNKVCSANLGHACQLNAYGSSGSLTGSDSSFLGNFAGKNIASAGTSNDAKTAQTSAGFGKI

SEQ ID NO: 2263 - DNA, 4919 bp, BACILLUS SP. P-358
tatggatttttattttgagcaaaaaaatatccggcacaaaggccggacactaaaaatgattttatgatcatttaaaaggggggtatgaaaaagcttatcttttccatgtctttatattacccattaaatatgaacaaactatgaataaagaattaagtttctattaataatgattttttatcgattgtttttcataacacatataatcatttgataagattctacaaaaatcacaatattggtacatttcaaagcaatttatatacctttatgattatcccttctatggtaaactctcttttgtagacaccttagactgaatattcagatagttctttagtcctattaaaaggggggagagtttaatagttttattaacttatattaattaaatatcgaaaggagttcaattgaatgtgtgtttttaagcgtcttagttatctcactttggtggtcatgctcgcattcacaagtttattttctttcacatccattccactggttaaggctgaagaaaatatagcatccaccttcctttttgaagcagattttaataatgaaattactggggagcatccagcagaatttgatgtatctgaaggtggtggaaccatccgagtaacggaagtaccaaatgacactaacaaaagtgtatttttagatgatacaagtgaaactttggatgttaatttaaacaaatcttttgatgaacttgttggtgtggtcaccgttcaaatgaaattcatgcaaccgaagtatacaagttctactaaagtcatgagattaaaaggagacggaactcctgttattattgaaaccaaagacaataacattacatatcgtactggtagtaactttgattcattggtttcacttgaagaaaatgtctggtatgacataaaggttgaagttgatttaaacaatcaaacagcaaatgtttttattgatagtgaattaaaattggaaaacgctccattaaatcaaccaaccacaaaaattaaatattttgaaacattcacacctggaagtaaagcgcttgggcattatgtggatgacattaaaatctcaggttctttactagaggttgaaccagaacaaccgggcgaacctacacctcctactgaacctaatacagatggtgtttacgaagcagaagacggaaaactaaccaactcaattatcgacaacaaacatcctggttttactggtaccggatttgtagatatggtaccgaacgcgcccggtggggcaattgaatggactatagatgttcctgtagatggcgagtatactttagattttcgttttgctcatggtgggaccgatgagcgcccttcagaaattaaagtgaatggagaaataatcgatccaaagcttgcctttaacccttcaggcggttgggcgaattgggtttatacctcaactaacgctactttaaaagctggtgaaaacgtcattgttgctaccggagttggccccagtggtggagcgaatattgatcatttaaaagtttttatggaagttgatcatacctacgaggcggaagatgccctattagatgaaaatggtgttattattgataaccaacatcttgggtttacaggaacaggatttattgattttaaaccaaatcagccaggtagctgggttgagtggactgtaaatgttccgactgacggtgaatacttccttggcttcagatatgcttctggtggaactgatgcgagaccagctgagattaaagtgaatgataaggttgtagcagaatctctcgcttttgatccaactggcgcatgggcaacatgggtttatacttctacgaaggcaactctaaaagctggtgaaaacaaaatacgagcaaccggagttgggcctagtggtggggcaaatattgaccatttacggattcataatacagaaagtggatcctctgatgttccaattaagatagaggattctaacatgacagatgttgtcagcggactttatctgaaaaaattaaatgaattgggaatcctcgttgacattcaacctgctgataccgattcgattacaagacttgaattcatggccttaattaatagcaaacttggcctagtaaagaaagaacaatttaagggcttagattctgaatcaaaagtatgggaagtctcccttaatgagtgggattcttatgttcttgccgcagcaaagcaagctggatatatggatgagctaataaaaaatggaaaggtacatcctgaaaaaacgcttaagaaaaaggatgccgtaaaaatcgttcaaaaattaaatggttctgctgtattaacaaataacaaagatcttacatggggagaagccaagattttagttgattccatcccaactgaaggacatagtaaaaccgttcaaatcgcaaatgttcatgcagtatcaaacaatataattgctgtaacattaaatagtagtttcgatgattttgatttctctgatataaatgtggtttaccctacaggaaattggtcgactctaagtcctaactttaaaaatcttagaatcgataagggtgcaaaaggtgtaaacaaatttggacaaactgtgctaattttaaacagcttagatgagttgaatcaaaacggtcagtatattgtagaccctgagaaggttgcttataaaggtaatctaaatgatgccattcgaagagctgataatttactaacctggcaaatggaacatggtggttggacaaagaattggtcctacatatacgaacgcccttggaatggagccgaaccacgctctgaatggattgcaaatgaggtagaattaggaacaattgacaatgatgcaaccattaaagaaattctatttttagctgaggtataccgtgaaactggtgacaaaaggtataaagaaagcattgaaaaaggcttcgagttcttgttcaaattacaatatggtacaggtggcttcgctcaggtttatccaagtcggggcaactactcagactatgttaccttcaatgacgaagccatgataaatgtgctagaactgatggatgatgttgtagaaaaaagatatccatttgattcagatgttttggatgattcattcaatcaaagaatagaagaatctataacgagtgggattgattatatcttaaaagcacaaatcaaattccctgatggcactttaacggcatggggtgcacaacatgacccatacacatttgaaccacaaaaagcacgtgcttatgagcatgcttcagtttcaggtcaagaatctgtgggcattattagattccttatgtctcgtccacaaactgatgatataaaaagttctattcgtgcagcactacaatggcttgatgacgttaaactagaaaacattcgttatataagtggtgatcctaataatgtgtattttgtcgaagatctaaattcaacagcatggtacagattttatgagataggtacaaatcgaggtatcttctccggtcgtgatggggttattaaatataacattatggaaattgaagaagaacgacgaaatggctattcttggggcggacattgggggacaaaattattaagtattgctgaagaaaccgggtattttacaaacaatgtatatatacaggttattggtacgaactctaaagacaataacggtagaaccctaacagaaagtaatataaaaatggtgaaaagtttagataaacaaataaaccaaatcaaaaatgaaatagttgtggctaaagatggaactggtaattatgaaaccattcaggctgcaattgacgctgttccaataaacaacaagattccagttacaatctatattagaaatggtgtatacaaagaagttgttactgtaccaaataacaaaccatttattacaatgattggtgaagatccggaaaaaacaatcattacttacgataactttgcaggaagagataatggtgttggcggtactcttggtacaagtggaagtgcaagtgtgtacctgcgtgcggatgactttagagtaaccaatgttacatttgaaaactcatttgatgaaaactctactgaagtaagcggaaaacaagcagttgctgtttatgcagctggtgatcgtcaatattttaataatgttagattcattggtaaccaggataccttatatgttcactcgggaagccaatactataatcacgtatatgttgagggtgacgtcgacttcatctttggggccgccagtgctgttttcgaacattcagtgattcactcacttgacagaggttcagaatcaaacaatggatatatcactgcagcaagcaccttaataacagatccttacggtatcttgattaaggatagtaagctaacaagtgatgttccagcaggaactgtatatttaggcagaccttggccagctggtggaaatccgaatgcaaaaggtagtgttgtcgttatgaatagtgaacttggcgatcacattaaaggagaaggatggacttccatgagtggcttgaatccggaagatgcccgtttgtttgaatataaaaacttcggacctggcgctgcaatcaacgaatcaagaagacaacttacagatgaagaagccacaaactggaccgtgcaaaacgttcttaagggctgggacccaatggaagtagaagtatgtgaaaaaccaggaaacggcccaaaaacagagaaaaggctaaaaccaggaacgtacccagtaccaggatattgtaaaaaataggtgaatagcaaaacatttgaagcacttctaggcttataacttaatagtaaaagagagggctcccctctcttttttaaacttccacatccacaaatgcatcttttttctttttcactcctgctataatgctgagcgtaatgatcacaattgaagccaccattagcgttccagagaatggacgtgtgaag

SEQ ID NO: 2264 - protein, 1438 aa, BACILLUS SP. P-358
MCVFKRLSYLTLVVMLAFTSLFSFTSIPLVKAEENIASTFLFEADFNNEITGEHPAEFDVSEGGGTIRVTEVPNDTNKSVFLDDTSETLDVNLNKSFDELVGVVTVQMKFMQPKYTSSTKVMRLKGDGTPVIIETKDNNITYRTGSNFDSLVSLEENVWYDIKVEVDLNNQTANVFIDSELKLENAPLNQPTTKIKYFETFTPGSKALGHYVDDIKISGSLLEVEPEQPGEPTPPTEPNTDGVYEAEDGKLTNSIIDNKHPGFTGTGFVDMVPNAPGGAIEWTIDVPVDGEYTLDFRFAHGGTDERPSEIKVNGEIIDPKLAFNPSGGWANWVYTSTNATLKAGENVIVATGVGPSGGANIDHLKVFMEVDHTYEAEDALLDENGVIIDNQHLGFTGTGFIDFKPNQPGSWVEWTVNVPTDGEYFLGFRYASGGTDARPAEIKVNDKVVAESLAFDPTGAWATWVYTSTKATLKAGENKIRATGVGPSGGANIDHLRIHNTESGSSDVPIKIEDSNMTDVVSGLYLKKLNELGILVDIQPADTDSITRLEFMALINSKLGLVKKEQFKGLDSESKVWEVSLNEWDSYVLAAAKQAGYMDELIKNGKVHPEKTLKKKDAVKIVQKLNGSAVLTNNKDLTWGEAKILVDSIPTEGHSKTVQIANVHAVSNNIIAVTLNSSFDDFDFSDINVVYPTGNWSTLSPNFKNLRIDKGAKGVNKFGQTVLILNSLDELNQNGQYIVDPEKVAYKGNLNDAIRRADNLLTWQMEHGGWTKNWSYIYERPWNGAEPRSEWIANEVELGTIDNDATIKEILFLAEVYRETGDKRYKESIEKGFEFLFKLQYGTGGFAQVYPSRGNYSDYVTFNDEAMINVLELMDDVVEKRYPFDSDVLDDSFNQRIEESITSGIDYILKAQIKFPDGTLTAWGAQHDPYTFEPQKARAYEHASVSGQESVGIIRFLMSRPQTDDIKSSIRAALQWLDDVKLENIRYISGDPNNVYFVEDLNSTAWYRFYEIGTNRGIFSGRDGVIKYNIMEIEEERRNGYSWGGHWGTKLLSIAEETGYFTNNVYIQVIGTNSKDNNGRTLTESNIKMVKSLDKQINQIKNEIVVAKDGTGNYETIQAAIDAVPINNKIPVTIYIRNGVYKEVVTVPNNKPFITMIGEDPEKTIITYDNFAGRDNGVGGTLGTSGSASVYLRADDFRVTNVTFENSFDENSTEVSGKQAVAVYAAGDRQYFNNVRFIGNQDTLYVHSGSQYYNHVYVEGDVDFIFGAASAVFEHSVIHSLDRGSESNNGYITAASTLITDPYGILIKDSKLTSDVPAGTVYLGRPWPAGGNPNAKGSVVVMNSELGDHIKGEGWTSMSGLNPEDARLFEYKNFGPGAAINESRRQLTDEEATNWTVQNVLKGWDPMEVEVCEKPGNGPKTEKRLKPGTYPVPGYCKK

SEQ ID NO: 2265 - DNA, 2716 bp, Aspergillus niger
actagtagtctaatcgctacaaagtgcatcaggggagccagccatgggaacaaagctcgatgcaatctgacttaatcagtctccacatcgagctgggcgtgaaactgatggacactccgccatctactcgaaaccatctctaattaagcactcacggctccacttcttctctgggcttcctccgtgccgctcggacagctcactggatgctcccagtggagtcgtttcaccggatcccctcaacgctgacgatcgcattcccaaggcatccactagctctctcaagcagaccagggcagtgaggtgatcggcggtggcctcacgagtcacgacattactgtcgccgggacccagatgtttattctccctccctgtcgacctaatggcccacaccacatccaccgtcataacgccgatattggtcgagattgcgctggagtcgcagagggagtcttcggcatacccaccggctccgtaaacctccatcaggagaattgttccaaacttccatgagccatggcttcgaggaccacagccctctatataagggacgagcccgtcgaccgtctcggatcctttcctctctggctcaacacacacaactttgtcattctttctcttgtttctcttttgtttctaattgtaacctttgtcactcttttctaaaccgacttgcaaaacttccaggatgaagtacgctgctgctctcacggctattgccgccctcgctgcccgcgccgctgctgtcggtgtctccggcactcccgtgggtttcgcctcctccgccactggtggtggtgatgctacccccgtctaccctaccaccaccgatgagctggtctcttacctcggtgatgacgaggcccgtgtcattgtcctgtccaagacgtgagttttgaatccaaagcaatgaacgaatcgattcccggctgaccagtgtccgaatttgccagtttcgacttcactgacactgagggcactaccacgaccaccggttgcgctccctggggtactgcctccggctgccagctggccatcaacaaggacgactggtgcaccaactacgagcccgatgctcccaccaccaccgtcacctagtaagttgccttctgaggtatcctcgagtataaggaagaggaaatgctgacaagaggatagcaacactgctggtgaactcggtatcaccgtcaactccaacaagtccttgatcggtgagggtaccagcggtgtcatcaagggccgtggtctccgcatggtcagcggtgtctccaacatcatcatccagtatgcatcgtccaggactacatacattactcccatcgcaaactaaccatggaattcccacaggaacattgctgtcaccgacatcaaccccgagtacgtctggggtggtgacgccatcaccctcgacgaggctgacttggtctggattgaccacgttactgtaagtcgccatccagcatcatgattttcatccttccaccactaatgaatgcttcagactgcccgcattggtcgccagcactacgtcctcggtaccgacgccgacagccgtgtctccatcaccaacaactacatcaacggcgagtctgactactctgctacttgcgacggccaccactactggaacgtgtaccttgacggctctagcgacaaggtcaccttcagtggcaactacctgtacaagacctccggccgtgcccccaaggtccaggacaacacctacctccacatctacaacaactactgggagaacaactcgggccacgctttcgagatcggctccggtggctacgtcctcgccgagggtaactacttctccaacgtcgacaccgtcctcgagaccgacaccttcgagggtgctctcttctcctctgacagcgcctcctccacctgcgagtcctacattggccgttcctgcgttgccaacgtcaacggcggtgacctcaccggcacctccaccaccgtcctctccaacctcagcggcgacaccctcccctctgctgatgctgccagcaccagccccgcctccaacgctggtcagggtaacctgtaagcggtatcgctccgtcgggctcttactgcagatcgctttggtgatgttgtcgagtttgatgattcagacaagacgagttgagttttctgctgttgtacagcggaaaagtgtgttcgcttagattctatcttagcctaatcaataattctaagatggacttgatccatagtaattctccattcaattgtgatttagtaaatttgattttctttgcctagtcgcgcttctaaactaggatcacagctgctcttagatcctcgatgcccaaggccactaacgctttctgcctcaggactccacagtccgagacggatgtactgcctgaggcctaagtgtgcttctgcccaaggcaacaatgggcatgatcatacattcactatacctgtgctctaaggaatagtaggatcggatgtgaaccattatatttaactgagtgatctgtggtcttttcatatttgcaatgacttgcttaacttatttggccgttcttccatagatgcgatcatgttcggtagacttcaaaaacatgtgattgctgacatattctgcctatttctgctgcaaggcgtatgaaaaatggcattcctgccgtggctaatggccaaatgctatggcatcacaatactttttctgctggctatcacattgcatcgagctagc

SEQ ID NO: 2266 - protein, 373 aa, Aspergillus niger
MKYAAALTAIAALAARAAAVGVSGTPVGFASSATGGGDATPVYPTTTDELVSYLGDDEARVIVLSKTFDFTDTEGTTTTTGCAPWGTASGCQLAINKDDWCTNYEPDAPTTTVTYNTAGELGITVNSNKSLIGEGTSGVIKGRGLRMVSGVSNIIIQNIAVTDINPEYVWGGDAITLDEADLVWIDHVTTARIGRQHYVLGTDADSRVSITNNYINGESDYSATCDGHHYWNVYLDGSSDKVTFSGNYLYKTSGRAPKVQDNTYLHIYNNYWENNSGHAFEIGSGGYVLAEGNYFSNVDTVLETDTFEGALFSSDSASSTCESYIGRSCVANVNGGDLTGTSTTVLSNLSGDTLPSADAASTSPASNAGQGNL

SEQ ID NO: 2267 - DNA, 1291 bp, Erwinia carotovora
taccccctatcagtctgatgaagttgaacaggctgcgaaccgtatttttaatggcggcgcggtaaaaggctggtgatgataatcgtagcgctgccattttactaaaagatggcggcgtattaattgggtattgaattattcgcaaggttgtttttttattaaactcgattaataagcgtaatgaaatcctttctatacaatttttaattgtcggaggcgtattatttagtctcaattaaataatacgctggaagacattattattcactcattgtaaaaaggaaaacttatggcttatccaacaacaaatcttactgggcttattggttttgcaaaagcggcaaaagttaccggaggaacgggcggtaaagtcgttacggtaaattctttggccgattttaaatcagcggtgagcggttccgcaaaaactattgtggtgctgggatcatcgctgaaaacgtcggccttgaccaaggtggtatttggcagcaataaaaccatcgtcggttctttcggtggcgctaatgtactgaccaatattcacctgcgtgctgagagcaattcatctaacgtcattttccagaatctggtttttaaacatgatgttgccatcaaagataatgacgatatccagctgtatttgaactacggtaaagggtattgggtggatcactgttcatggcctgggcatacgtggagcgataacgatggtagcctcgataaactgatttatatcggcgagaaggcggattacatcacgatcagtaactgcttattctcaaaccataaatatggttgcattttcggccatccggctgacgataataacagcgcttacaatggctatccacgtttgactatttgccataactattacgaaaatattcaggtgcgtgcgcccggcctgatgcgttatggctatttccacgtattcaataactacgtcaataaattccagttggcttttaccgtcgcgcaaaatgccaacgttatttctgaacgcaacgtatttggcagcggtgctgaaaagaaagggatggttgatgataaaggcaatggttcaacctttaccgataatggcagttcgccagcagcggtagcgagtaaatcgccagcggcgaaatggacggcatcatctaactattcatacagtttgatgacaaccgcggcggcccaatcctgggttgtttcgaatgcaggggcacaaaatagtgcgctgaaattcccatcataatcacggaaggtttattttatgacgtacctgcatgctcacttttattgataattgaaa

SEQ ID NO: 2268 - protein, 314 aa, Erwinia carotovora
MAYPTTNLTGLIGFAKAAKVTGGTGGKVVTVNSLADFKSAVSGSAKTIVVLGSSLKTSALTKVVFGSNKTIVGSFGGANVLTNIHLRAESNSSNVIFQNLVFKHDVAIKDNDDIQLYLNYGKGYWVDHCSWPGHTWSDNDGSLDKLIYIGEKADYITISNCLFSNHKYGCIFGHPADDNNSAYNGYPRLTICHNYYENIQVRAPGLMRYGYFHVFNNYVNKFQLAFTVAQNANVISERNVFGSGAEKKGMVDDKGNGSTFTDNGSSPAAVASKSPAAKWTASSNYSYSLMTTAAAQSWVVSNAGAQNSALKFPS

SEQ ID NO: 2269 - DNA, 2172 bp, Erwinia carotovora
tactgcaaaaaaacggattaattactctaaagcctgacacgggcttattgccgacggtgctggatatcacgacgaatccacacaacctgcgtattatggaagtggaagggcacagttgccgcgtttgttagacgatccacaagtgacggtagccattattagtacgacctatattcagcaaacgggcttaacgccaacgaaagacggtatttttattgaggataaagaatcaccgtatgtgaatatcattgtgacgcgtgaaaataataaagaggcggaaaacgtcaaaaaatttattcaggcctatcagtctgatgaagttgaacaggctgcgaaccgtatttttaatggcggcgcggtaaaaggctggtaatgataataatgtgataatcgtagctagcctgccattttactaaaagatggcagcgtattaattgggtattgaattattcgcaaggttgtttttttattaaactcgattaataagcgtaatgaaatcctttatatacaatttttaattgtcggaggcgtgttatttgtttttgattaaataatacgttggaagacattattattcactcattgtaaaaaggaaaatttatggcttatccaacaacaaatcttactgggattattggttttgcaaaagcggcaaatgtaactggaggcacgggaggtaaagtcgttacggtaaattctttggccgattttaaatcagcagtgagcggttccgcaaaaactattgtggtgctgggattatcgctgaaagcctcggcattgaccaaggtggtatttggcagcaataaaaccatcgttggttctttcggtgggtacgctaatgtactgaccaatattcacctgcgcgctgagagcaattcatctaacgtcattttccagaatctggtttttaaacatgatgttgccatcaaagataatgacgatatccagctgtatttgaactacggcaagggatattgggtggatcactgttcatggcctgggcatacgtggagcgataacgatggtagcctcgataaactgatttatatcggcgagaaggcggattacatcacgatcagtaactgcttattctcaaaccataaatatggttgcatcttcggccatccggcagatgacaataacagcgcttacaatggctatccgcgtctgactatttgtcataactattacgaaaatattcaggtgcgtgcgcccggcctgatgcgctatggttatttccacgtcttcaaccaacctacgtcaataaattcaacctggcctttacagttgcgcaggaatgccaatctaatttctgagcgtaacgtatttggtaccggcgcggaaaataaagggatggttgatgataagggcaatggttcaaccttacggataatggcagttcaccggctgcggtggcgagcaaatcgcctgcggcgaaatggacggcgtcatctaactattcatacagtttgatgaccacgtcagcggcgaaatcctgggtggtgtctaatgcgggagcgcaaaatagcgctctcaaattcccatcgtaatcgttgaacgtatattgaatgacgttccagtatgcgcagtattttattgtgaagtgaaatgcattaaatactgagtctatcacactatgccacttggcgaatttgttaatgccgagtggcatagttattggttcatgttcaacgcaatataataggttcgttcaaaaaattaagcggcaatattatttctcgtattgtgagtaaaataccactctactgttttcttaattaactcttcggttgcatcgacatagtgttgcggtgatgttctgacttcctgctccagaatcagaggaagctcggtacaacccagaataattttctcaacgccagcctgcaacaggcgatcttttaccggtgacaacaggctataggcgccggcaatatcaccggatttataagcatagatgctttccattacctggtgttggtctgcatcatccggcgtgtagcaatcaatattatcggtaatcaggttgtcctgataaattctcgctttgaccgtcgctgtcgtcgctaataggccgacgcgtgtggtgttggcatgcttaatcgcctgacaggtcacatcaataatgctgatcatttccgcacggcactgctgttttaagtcattaaacca

SEQ ID NO: 2270 - protein, 290 aa, Erwinia carotovora
MAYPTTNLTGIIGFAKAANVTGGTGGKVVTVNSLADFKSAVSGSAKTIVVLGLSLKASALTKVVFGSNKTIVGSFGGYANVLTNIHLRAESNSSNVIFQNLVFKHDVAIKDNDDIQLYLNYGKGYWVDHCSWPGHTWSDNDGSLDKLIYIGEKADYITISNCLFSNHKYGCIFGHPADDNNSAYNGYPRLTICHNYYENIQVRAPGLMRYGYFHVFNQPTSINSTWPLQLRRNANLISERNVFGTGAENKGMVDDKGNGSTLRIMAVHRLRWRANRLRRNGRRHLTIHTV

SEQ ID NO: 2271 - DNA, 1645 bp, BACILLUS SP. YA-14
cccaagcttggcgcgataaagcaaggaaaaaaccaaaaggccaatgtcggccttttggtttttttgcggtctttgcggtgggattttgcagaatgccgcaataggatagcggaacattttcggttctgaatgtccctcaatttgctattatatttttgtgataaattggaataaaatctcacaaaatagaaaatgggggtacatagtggatgaaaaaagtgatgttagctacggctttgtttttaggattgactccagctggcgcgaacgcagctgatttaggccaccagacgttgggatccaatgatggctggggcgcgtactcgaccggcacgacaggcggatcaaaagcatcctcctcaaatgtgtataccgtcagcaacagaaaccagcttgtctcggcattagggaaggaaacgaacacaacgccaaaaatcatttatatcaagggaacgattgacatgaacgtggatgacaatctgaagccgcttggcctaaatgactataaagatccggagtatgatttggacaaatatttgaaagcctatgatcctagcacatggggcaaaaaagagccgtcgggaacacaagaagaagcgagagcacgctctcagaaaaaccaaaaagcacgggtcatggtggatatccctgcaaacacgacgatcgtcggttcagggactaacgctaaagtcgtgggaggaaacttccaaatcaagagtgataacgtcattattcgcaacattgaattccaggatgcctatgactattttccgcaatgggatccgactgacggaagctcagggaactggaactcacaatacgacaacatcacgataaacggcggcacacacatctggattgatcactgtacatttaatgacggttcgcgtccggacagcacatcaccgaaatattatggaagaaaatatcagcaccatgacggccaaacggatgcttccaacggtgctaactatatcacgatgtcctacaactattatcacgatcatgataaaagctccattttcggatcaagtgacagcaaaacctccgatgacggcaaattaaaaattacgctgcatcataaccgctataaaaatattgtccagcgcgcgccgagagtccgcttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacgggctgagctcttctgtcggctggacgccgtctctgcatgggtcgattgatgcttctgctaatgtgaaatcaaatgtcataaatcaagcgggtgcgggtaaattaaattaagaaagtgaaaaacacaaagggtgctaacctttgtgttttttaattaattaaaatgtttattaacttagttaaggagtagaatggaaaagggatcggaaaacaagtatataggaggagacctatttatggcttcagaaaaagacgcaggaaaacagtcagcagtaaagcttggg

SEQ ID NO: 2272 - protein, 420 aa, BACILLUS SP. YA-14
MKKVMLATALFLGLTPAGANAADLGHQTLGSNDGWGAYSTGTTGGSKASSSNVYTVSNRNQLVSALGKETNTTPKIIYIKGTIDMNVDDNLKPLGLNDYKDPEYDLDKYLKAYDPSTWGKKEPSGTQEEARARSQKNQKARVMVDIPANTTIVGSGTNAKVVGGNFQIKSDNVIIRNIEFQDAYDYFPQWDPTDGSSGNWNSQYDNITINGGTHIWIDHCTFNDGSRPDSTSPKYYGRKYQHHDGQTDASNGANYITMSYNYYHDHDKSSIFGSSDSKTSDDGKLKITLHHNRYKNIVQRAPRVRFGQVHVYNNYYEGSTSSSSYPFSYAWGIGKSSKIYAQNNVIDVPGLSAAKTISVFSGGTALYDSGTLLNGTQINASAANGLSSSVGWTPSLHGSIDASANVKSNVINQAGAGKLN

SEQ ID NO: 2273 - DNA, 1548 bp, Streptomyces thermocarboxydus
atgagacgagcaatcgccgtacggctctccgcgttactggccgccggggccctgacggccgccaccggcgtggcgctgtccagcaccaccgcgtccgccgccgccggaggcgtcaccggctacgcgacccagaacggcgggaccaccggcggggcgggcgggcagacggtccgcgccaccaccggcaccgcgatccaccaggccctttgcagtcgggccagcagctcgaccccgatcaccatccaggtcgagggcacgatcaaccacggcaacaccgccaaggtgtccggcagcagctgcaacaccgcggccggggtgatcgagctcaagcagatcagcaacgtcaccattgtcggcgtcggcaacggcgccgtcttcgaccagctgggcatccacatccgcgaggcgagcaacatcgtcatccagaacgtgacggtcaagaacgtcaagaagtccggctcgcccacgtcgaacggcggcgacgccatcggcatggaaagcgatgtcaggaacgtctgggtggaccacgtcacgctggaggcgtccggcggtgagtccgagggctacgacggcctgttcgacatgaaggacaacacccagtacgtgacgctgtcgtacagcatcctgcgcaactccgggcgcggcggcctcatcggctccagcgagagcgaccgctccaacgggtacgtgacgttccatcacaacctgtacgagaacatcgactcccgtacgcccctgctgcgcggcggcatcgcgcacatgtacaacaaccactacaggcagctgaacgagtccggcatcaactcccgcgccggcgcccgcgcgaaggtggacaacaactacttcgaggactccaaggacgtcctcggcaccttctacaccagcgaggccggctactggcaggtcagcggcaacatcttcgacaacgtcacctggggctcgcgcgacgacgaccacaacccggcgggcccgaaccccacgtcgaacacgtccgtgagcatcccgtacggcttcaccctggacggggcgaactgcgtgccgagcgtggtggcgcagacggcgggcgcgggcaagggcctgaaggtgtcggacggcagctgcaccccgcagagcccggacccgaccgaccccgggccgacggacccgggtgagccgaccgaccccggtcccaccgacccgcccgccggcaccaacctgagcctcggcgcgggcgcggacggctcctccaaggcgtccggcaccagctacggcaacgtcgtggacggcaacacgagcacctactggtcgccgtccggcacgaccggctcggtctcggtgaagtggggctccgccaccaccgtgtccaaggtcaacatccgcctggcctccggctccgggaccatcggcgcctaccgcctcctgaaccacgacacgggtgcggtcctggcctccggcagcggagcgggcacggtcggcttctccccggcctccctgaagaagatcaccctcgagatcaccaacgcctcgggcaccccgcgcatcgcggagttcgagacgtacgcgagctga

SEQ ID NO: 2274 - protein, 515 aa, Streptomyces thermocarboxydus
MRRAIAVRLSALLAAGALTAATGVALSSTTASAAAGGVTGYATQNGGTTGGAGGQTVRATTGTAIHQALCSRASSSTPITIQVEGTINHGNTAKVSGSSCNTAAGVIELKQISNVTIVGVGNGAVFDQLGIHIREASNIVIQNVTVKNVKKSGSPTSNGGDAIGMESDVRNVWVDHVTLEASGGESEGYDGLFDMKDNTQYVTLSYSILRNSGRGGLIGSSESDRSNGYVTFHHNLYENIDSRTPLLRGGIAHMYNNHYRQLNESGINSRAGARAKVDNNYFEDSKDVLGTFYTSEAGYWQVSGNIFDNVTWGSRDDDHNPAGPNPTSNTSVSIPYGFTLDGANCVPSVVAQTAGAGKGLKVSDGSCTPQSPDPTDPGPTDPGEPTDPGPTDPPAGTNLSLGAGADGSSKASGTSYGNVVDGNTSTYWSPSGTTGSVSVKWGSATTVSKVNIRLASGSGTIGAYRLLNHDTGAVLASGSGAGTVGFSPASLKKITLEITNASGTPRIAEFETYAS

SEQ ID NO: 2275 - DNA, 1140 bp, Pseudomonas viridiflava
atggttaagtctcgaaaaaatctgccaatcacactcgtcagcggtctgttcggttcgctgatgctggccagtctttctgctcatgccgacatcgcaaccgatgtagccaccaccggctgggccacccagaacggtggcaccaaaggcggctcacgagcggctgcgaaggacatcttcaccgtcaagaacgctgctgaactgaaaagcgcgctggccgcctcagtgggcagcaatggtcgcatcatcaagatcaccggcctgatcgatgtcagcgaaggcaaggcgtacaccaagacctcggacatgaaagtccggggccgtctggacgttcccggcaagaccaccatcgtgggcaccagcagcagtgcggaaatccgagagggttttttctatgccaaggaaaacgatgtgatcatccgcaacctgaccattgagaacccgtgggatcccgagccggtctgggatgccgacgacggcagcgcgggcaactggaactccgagtacgacagcctgacagtcgaaggtgccaacaacgtgtgggtcgaccatgtgaccttcactgacggccgtcgcacagacgatcaaaacggtaccgccaacggtcggcccaagcagcatcacgacggtgctctggacgtgaagaacggcgccaactacgtgaccatctcgtattcgatcttcaagaaccacgagaagaacaacctgatcggttcgagcgacagcaagaccaccgacgacggcaagctcaaggtcactgtccacaacaccctgttcgaaaacatttcggctcgcgcgccgcgtgtacgcttcggccaggtccacctgtacaacaactatcatgtaggcagcaccagccacaaaatctatccgttctcttacgcgcacggcgtgggcaagagttcgaagattttctcggaacagaacgcattcgagatcagcggcatcagtggctgtgacaagattgccggtgactacggtggaagcgtataccgtgacagcggctcgcgcctgaatggcaccgtattgagctgctcatggagcagcagcatcggctggacgcctccttacagctatagcccgctgagcgccgacaaggtggctgcggacgtcaaggccaaggctggcgcaggcaaaatctga

SEQ ID NO: 2276 - protein, 379 aa, Pseudomonas viridiflava
MVKSRKNLPITLVSGLFGSLMLASLSAHADIATDVATTGWATQNGGTKGGSRAAAKDIFTVKNAAELKSALAASVGSNGRIIKITGLIDVSEGKAYTKTSDMKVRGRLDVPGKTTIVGTSSSAEIREGFFYAKENDVIIRNLTIENPWDPEPVWDADDGSAGNWNSEYDSLTVEGANNVWVDHVTFTDGRRTDDQNGTANGRPKQHHDGALDVKNGANYVTISYSIFKNHEKNNLIGSSDSKTTDDGKLKVTVHNTLFENISARAPRVRFGQVHLYNNYHVGSTSHKIYPFSYAHGVGKSSKIFSEQNAFEISGISGCDKIAGDYGGSVYRDSGSRLNGTVLSCSWSSSIGWTPPYSYSPLSADKVAADVKAKAGAGKI

SEQ ID NO: 2277 - DNA, 1140 bp, Pseudomonas viridiflava
atggttaagtctcgaaacaatctgccaatcaaacttgccagcggtctcttcggttcgctgatgctcgtcagtctttctgctcatgccgatatcgcaaccgatgtagccaccaccggctgggccacccagaacggcggcaccaaaggcggctcacgggctgctgcgaaggacatcttcaccgtcaagaacgctgctgaactgaaaagcgcgctggccgcctcggtgggcagcaacggccgcatcatcaagatcaccggcctgatcgatgtcagcgaaggcaaggcgtacaccaagacctcggacatgaaagtccggggccgcctggacatccccggcaagaccaccatcgtgggtaccagcagcagtgcagaaatccgtgagggtttcttctacgccaaggaaaacgatgtgatcatccgcaacctgaccatcgagaacccgtgggatccggagccgatctgggacgccgatgacggcagcgcgggcaactggaactccgagtacgacagcctgaccgtcgaaggtgccaacaacgtgtgggtcgaccacgtaacctttaccgacggccgccgcaccgatgatcagaacggcactgccaacggtcgccccaagcagcatcacgacggtgccatggacgtgaagaacggcgccaactacgtgaccatctcgtattcgatcttcaagaaccacgagaagaacaacctgatcggttcgagcgacagcaagaccaccgacgatggcaagctcaaggtcacgatccacaacacgctgttcgaaaacatctccgctcgcgcaccgcgtgtgcgcttcggccaagtgcacctgtacaacaactaccacgtgggcagcaccagccacaaaatctaccccttcacctacgcgcatggcatgggcaagagttcgaagattttctctgagcagaacgccttcgaaatcagcggcatcagcggctgcgacaagattgccgccgactacggcggaagcacctaccgtgacagcggctcgcgcctgaatggcacagccctgagctgcccgtggagcaccagcatcggctggaccccgccttacagctatagcccgctgagcgccgacaaggtggctgcggacgtcaaggccaaggctggcgcaggcaaaatctga

SEQ ID NO: 2278 - protein, 379 aa, Pseudomonas viridiflava
MVKSRNNLPIKLASGLFGSLMLVSLSAHADIATDVATTGWATQNGGTKGGSRAAAKDIFTVKNAAELKSALAASVGSNGRIIKITGLIDVSEGKAYTKTSDMKVRGRLDIPGKTTIVGTSSSAEIREGFFYAKENDVIIRNLTIENPWDPEPIWDADDGSAGNWNSEYDSLTVEGANNVWVDHVTFTDGRRTDDQNGTANGRPKQHHDGAMDVKNGANYVTISYSIFKNHEKNNLIGSSDSKTTDDGKLKVTIHNTLFENISARAPRVRFGQVHLYNNYHVGSTSHKIYPFTYAHGMGKSSKIFSEQNAFEISGISGCDKIAADYGGSTYRDSGSRLNGTALSCPWSTSIGWTPPYSYSPLSADKVAADVKAKAGAGKI

SEQ ID NO: 2279 - DNA, 1140 bp, Pseudomonas viridiflava
atggttaagtctcgaaacaatctgccaatcaaacttgccagcggtctcttcggttcgctgatgctcgtcagtctttctgctcatgccgatatcgcaaccgatgtagccaccaccggctgggccacccagaacggcggcaccaagggcggctcacgggctgctgcgaaggacattttcaccgtcaagaacgctgctgaactgaaaagcgcgctggccgcctcggtgggcagtaacggccgcatcatcaagatcaccggcctgatcgatgtcagcgaaggcaaggcgtacaccaagacctcggacatgaaagtccggggccgtctggacatccccggcaagaccaccatcgtgggcaccagcagcagcgcagaaatccgtgagggtttcttctacgccaaggaaaacgatgtgatcatccgcaacctgaccatcgagaacccctgggacccggagccgatctgggacgccgatgacggcagcgcgggcaactggaactccgagtacgacagcctgaccgtcgaaggtgccaacaacgtgtgggtcgaccacgtgacctttaccgatggccgccgcaccgatgatcagaacggcactgccaacggccgtcccaagcagcatcacgacggtgccatggacgtgaagaacggcgcgaactacgtgaccatctcgtattcgatcttcaagaaccacgagaagaacaacctgatcggttcgagcgacagcaagaccaccgacgatggcaagctcaaggttacgatccacaacacgctgttcgaaaacatctccgctcgggcaccgcgtgtgcgcttcggccaggtgcacctgtacaacaactaccacgtgggcagcaccagccacaaaatctaccccttcacctacgcgcatggcgtgggcaagagttcgaagattttctccgagcagaacgccttcgaaatcagcggcatcagcggctgcgacaagattgccgccgactacggcggaagcgtttaccgtgacagcggttcgcgcctgaatggcacaactctgagctgctcgtggagcaccagcatcggttggacaccgccttacagctacagcccgctgagcgccgacaaggtggctgcggacgtcaaggccaaggctggcgcaggcaaaatctga

SEQ ID NO: 2280 - protein, 379 aa, Pseudomonas viridiflava
MVKSRNNLPIKLASGLFGSLMLVSLSAHADIATDVATTGWATQNGGTKGGSRAAAKDIFTVKNAAELKSALAASVGSNGRIIKITGLIDVSEGKAYTKTSDMKVRGRLDIPGKTTIVGTSSSAEIREGFFYAKENDVIIRNLTIENPWDPEPIWDADDGSAGNWNSEYDSLTVEGANNVWVDHVTFTDGRRTDDQNGTANGRPKQHHDGAMDVKNGANYVTISYSIFKNHEKNNLIGSSDSKTTDDGKLKVTIHNTLFENISARAPRVRFGQVHLYNNYHVGSTSHKIYPFTYAHGVGKSSKIFSEQNAFEISGISGCDKIAADYGGSVYRDSGSRLNGTTLSCSWSTSIGWTPPYSYSPLSADKVAADVKAKAGAGKI

SEQ ID NO: 2281 - DNA, 1140 bp, Pseudomonas viridiflava
atggttaagtctcgaaacaatctgccaatcaaacttgccagcggtctcttcggttcgctgatgctcgtcagtctttctgctcatgccgatatcgcaaccgatgtagccaccaccggctgggccacccagaacggcggcaccaagggcggctcacgggctgctgcgaaggacattttcaccgtcaagaacgctgctgaactgaaaagcgcgctggccgcctcggtgggcagtaacggccgcatcatcaagatcaccggcctgatcgatgtcagcgaaggcaaggcgtacaccaagacctcggacatgaaagtccggggccgtctggacatccccggcaagaccaccatcgtgggcaccagcagcagcgcagaaatccgtgagggtttcttctacgccaaggaaaacgatgtgatcatccgcaacctgaccatcgagaacccctgggacccggagccgatctgggacgccgatgacggcagcgcgggcaactggaactccgagtacgacagcctgaccgtcgaaggtgccaacaacgtgtgggtcgaccacgtgacctttaccgatggccgccgcaccgatgatcagaacggcactgccaacggccgtcccaagcagcatcacgacggtgccatggacgtgaagaacggcgccaactacgtgaccatctcgtattcgatcttcaagaaccacgagaagaacaacctgatcggttcgagcgacagcaagaccaccgacgatggcaagctcaaggttacgatccacaacacgctgttcgaaaacatctccgctcgggcaccgcgtgtgcgcttcggccaggtgcacctgtacaacaactaccacatgggcagcaccagccacaaaatctaccccttcacctacgcgcatggcgtgggcaagagttcgaagattttctccgagcagaacgccttcgaaatcagcggcatcagcggctgcgacaagattgccgccgactacggcggaagcgtttaccgtgacagcggttcgcgcctgaatggcacaactctgagctgctcgtggagcaccagcatcggttggacaccgccttacagctacagcccgctgagcgccgacaaggtggctgcggacgtcaaggccaaggctggcgcaggcaaaatctga

SEQ ID NO: 2282 - protein, 379 aa, Pseudomonas viridiflava
MVKSRNNLPIKLASGLFGSLMLVSLSAHADIATDVATTGWATQNGGTKGGSRAAAKDIFTVKNAAELKSALAASVGSNGRIIKITGLIDVSEGKAYTKTSDMKVRGRLDIPGKTTIVGTSSSAEIREGFFYAKENDVIIRNLTIENPWDPEPIWDADDGSAGNWNSEYDSLTVEGANNVWVDHVTFTDGRRTDDQNGTANGRPKQHHDGAMDVKNGANYVTISYSIFKNHEKNNLIGSSDSKTTDDGKLKVTIHNTLFENISARAPRVRFGQVHLYNNYHMGSTSHKIYPFTYAHGVGKSSKIFSEQNAFEISGISGCDKIAADYGGSVYRDSGSRLNGTTLSCSWSTSIGWTPPYSYSPLSADKVAADVKAKAGAGKI

SEQ ID NO: 2283 - DNA, 966 bp, Aspergillus fumigatus
atgaaattcgttgctactctcattgcctgcggcctgtctggactggccctggctgctcctaccgctactgtcaactcgttggggaagcgcgccgccgatgatgctgcctttggttacgccagcttgaacggaggcaccaccggtggtgctggaggtaccacgaccaccgtctcctcctacgcagccttcactgctgccgtctccagtgatgcgaagaaggtggtctacgtcagcggccccatcaagcagagcgccaagcaggtcaaggttggcagcaacaccagcatcatcggcaaggactccaccgctgtgctcgagggattcggccttctggtcaaggagaagtccaacgtgatcatccggaacctgggagtcaagaaggttctggcggagaatggagatgccattggcattcaatactccaacaatgtgtgggttgaccacgtcgatgtctcctctgaccgtgaccacgacaaggactactacgacggcctgattgatgtcacccacgccgccgactacgtgaccatctccaacagctacatccacgaccactggaaggcgtccctggtgggccactccgacaacaacggcgatgaggacaagggccacctgcgcgtgacgtacgccaacaactactggagcaacatcaactcgcgtgctccctccctccgcttcggcaccggccacatctacaacagctacttcgagaacgtcagcgacggcatcaacacccgcgacggcgcccaggtcctcgtcgagtccaaccagttcgtcggctccagcaaggccctctactccaccgacgacggctacgccgttgagagggacaacgactttggcggcgccaagaacactgccctgcagggtaccttgaccacggttccctactcttactctctgcttggatccagcaaggtcaagtcggctgttgttggagtggccggtcagactctgaagttctag

SEQ ID NO: 2284 - protein, 321 aa, Aspergillus fumigatus
MKFVATLIACGLSGLALAAPTATVNSLGKRAADDAAFGYASLNGGTTGGAGGTTTTVSSYAAFTAAVSSDAKKVVYVSGPIKQSAKQVKVGSNTSIIGKDSTAVLEGFGLLVKEKSNVIIRNLGVKKVLAENGDAIGIQYSNNVWVDHVDVSSDRDHDKDYYDGLIDVTHAADYVTISNSYIHDHWKASLVGHSDNNGDEDKGHLRVTYANNYWSNINSRAPSLRFGTGHIYNSYFENVSDGINTRDGAQVLVESNQFVGSSKALYSTDDGYAVERDNDFGGAKNTALQGTLTTVPYSYSLLGSSKVKSAVVGVAGQTLKF

SEQ ID NO: 2285 - DNA, 972 bp, Aspergillus niger
atgaccaacttcaagtggatcgttgccgccgccggtctcctgtctggacaggtcctggctgctcctactgccacttctacccatgccaagcgcgcaaccgtcagcgacgctgcgttcggctatgctagcctgaacggcggcaccaccggtggtgccggcggtactaccactaccgtctcgtcctacgctgccttcacctccgctgtctccggcgatgacgccaaggtcgtctacgtcgacggtaccatcaagcagaccgccgaccaggtcaagattggcagcaacacctccatcatcggcaaggacgccaacgccatcctcgagggattcggagttctcgtcaaggagaaggagaacgttatcatccgtaacctcggagtctccaaggtccttgctgacaacggcgatgccattggtgtccagtactccaacaacgtctggatcgaccactgcgatgtctcctccgaccgtgaccacgacaaggactactacgacggtctgattgacattacccacggctccgactacgtgaccgtctccaacaccttcatccacgaccactggaaggcctccctggtcggccactccgacagcaacgaggacgaggacagcggccacctcaccgtcacctacgccaacaactactggtacaacatcaactcccgcgctccctctttccgcttcggtaccggccacgtctacaacagctactacctggacgtcagcgacggcatcaacacccgtgacggcgcccagctgctcgtcgagtccaaccagttcgtcgactccaagaaggctctctactccaccgacgatggctacgccgtctccaacgacaacgacttcggtgattctgagaacactgccgaggagggtaccctgacttccatgccttatgactacacccttcttggctccgccaacgttaaggctgctgtcgtcggcactgccggtcagactcttactttctaa

SEQ ID NO: 2286 - protein, 323 aa, Aspergillus niger
MTNFKWIVAAAGLLSGQVLAAPTATSTHAKRATVSDAAFGYASLNGGTTGGAGGTTTTVSSYAAFTSAVSGDDAKVVYVDGTIKQTADQVKIGSNTSIIGKDANAILEGFGVLVKEKENVIIRNLGVSKVLADNGDAIGVQYSNNVWIDHCDVSSDRDHDKDYYDGLIDITHGSDYVTVSNTFIHDHWKASLVGHSDSNEDEDSGHLTVTYANNYWYNINSRAPSFRFGTGHVYNSYYLDVSDGINTRDGAQLLVESNQFVDSKKALYSTDDGYAVSNDNDFGDSENTAEEGTLTSMPYDYTLLGSANVKAAVVGTAGQTLTF

SEQ ID NO: 2287 - DNA, 936 bp, Emericella nidulans
tcccctgcgccggacctcaacgcccgtcatgaattgacccgccgccaggcctcagaaagctgcccgatcgggtactgcacacagaacggtggcactaccggtggtgcggccggtgacaccgtgaccgtgaccaatctggccgacctgactgaagccgccgagagcgatgggccgctgacgatcatcgtgtctgggtccatctcgggcagtgccaagatccgcgtggcctcagataagacgatctttggagagtcgggtagttctatcaccggtatcggattctacattcgccgcgtcagcaatgtcatcatgcggaacttgaagatcagcaaggtcgacgcagacaacggcgatgccattggcattgatgcctcctccaatgtctgggtcgatcattgcgacctctctggagacctcagcggtgggaaggatgacttggacggactggtcgatatcagccatggcgcggaatggatcaccgtctcgaacacttacttccacgaccattggaaaggttcccttatcggccactccgacaacaatgaagacgaggacctaggccatctgcacgtcacctacgctaacaactactggtacaacgtgtacagccgtacacccctgatccggttcgccacagtgcacatcatcaacaactattgggacagcctgatcgacacgggcgtgaactgccgtatggatgcacaggtgctgatccagtcctccgcgttccacaactgccccgacagagcgatcttcttcgccgactcagactacaccgggtatgctgtcgtagacgatgttgacctgggcggctcgagtaactcggtgcccgagggaaccctgacgcctagctccttgccttatgcggccattactgcgctgggatctggccaggttgcaagcgtgattccgggtacagccggacagaaattgtaa

SEQ ID NO: 2288 - protein, 311 aa, Emericella nidulans
SPAPDLNARHELTRRQASESCPIGYCTQNGGTTGGAAGDTVTVTNLADLTEAAESDGPLTIIVSGSISGSAKIRVASDKTIFGESGSSITGIGFYIRRVSNVIMRNLKISKVDADNGDAIGIDASSNVWVDHCDLSGDLSGGKDDLDGLVDISHGAEWITVSNTYFHDHWKGSLIGHSDNNEDEDLGHLHVTYANNYWYNVYSRTPLIRFATVHIINNYWDSLIDTGVNCRMDAQVLIQSSAFHNCPDRAIFFADSDYTGYAVVDDVDLGGSSNSVPEGTLTPSSLPYAAITALGSGQVASVIPGTAGQKL

SEQ ID NO: 2289 - DNA, 1742 bp, BACILLUS SP. P-4-N
acgattcctatacggaatggtaggcttttttccatttaagtgagtttaattttaagagagtttaattgcatattttatagtagggtgcaatggacctactttacatgcgaagcaatatatagccagtcctagtcgtatccctctttagaccagtagcctactccgcgtttttttataaacataatcacttgcttagatatgacttataatgtaagcgcttcactatagctatatagataaaatagctaagaaaaaataaaaaaccgcagtttatattcataatatttataaaattcaaaatagtgggctgatgatacttattttccctcctttcttatggtaggattcactcatgtgaaaggaaaggagggggcaggtctcagattgttttcgctagcgatccattttgtggtcatggtaggacaaactctatattgaaaaaggaagtgagagtatgatgagatcaagcatcgtcaagctagttgctttcagtgttgtggttatgttatggctcggtgtatcctttcaaacggcagaagcgaatacgccaaatttcaacttacaaggctttgccacgttaaatgggggaacaactggtggtgcaggtggagatgtagtgacggttcgtacagggaatgaattcataaacgctttgaagtccaaaaaccctaatcgtccgttaacaatttatgtaaacggtacgataacacctagtaatacgtctgatagtaagatcgatattaaggatgtttccaatgtatcgattttaggggttggtacaaatggacgattaaatgggattggtattaaagtatggcgagcgaataatatcatcattcgcaacttgacgatccatgaagtccatactggtgataaagatgcaattagcattgaaggtccctctcggaacatttgggttgaccataacgagctttatgccagtttgaacgttcataaagaccactatgacggcttgtttgacgtaaagcgcgatgcttacaatattaccttctcttggaattatgtccatgatggctggaaagcgatgctcatggggaactctgatagtgataactacgaccgaaacataacattccaccataactacttcaaaaatttaaactctcgcgtacctgcgtaccgttttggaaaggcgcacttgtttagcaattactttgagaacattttagaaacaggcattaattcacggatgggagcggaaatgctcgttgaacataacgtttttgagaatgccaccaacccgttaggattctggcatagcagtcgaacaggttattggaatgttgccaataaccgctatatcaatagcacgggtagcatgccgaccacttccacgaccaattatcgacctccttatccctatacggtcacaccagttggtgatgtgaaatcggttgtcacacgttatgcgggagttggtgtcatccagccgtaagcaagaaagccatccgagcgattgctctggtggctttttgcataaaaacatggaacggtttttaccaatcctttagtgaaatgacgaaaacaacgttagaaacgagcagacaagttcgctataatagctgtatgaatggtatgaatggagagttaagcgaatgagcgaatcctactacggtttgttagacgaagagaaggtgttcaaagatcctgtgcatcggtatattcacgttcgggatgaattgatctgggcattgatcggcacgaaggaatttcaacggctt

SEQ ID NO: 2290 - protein, 333 aa, BACILLUS SP. P-4-N
MMRSSIVKLVAFSVVVMLWLGVSFQTAEANTPNFNLQGFATLNGGTTGGAGGDVVTVRTGNEFINALKSKNPNRPLTIYVNGTITPSNTSDSKIDIKDVSNVSILGVGTNGRLNGIGIKVWRANNIIIRNLTIHEVHTGDKDAISIEGPSRNIWVDHNELYASLNVHKDHYDGLFDVKRDAYNITFSWNYVHDGWKAMLMGNSDSDNYDRNITFHHNYFKNLNSRVPAYRFGKAHLFSNYFENILETGINSRMGAEMLVEHNVFENATNPLGFWHSSRTGYWNVANNRYINSTGSMPTTSTTNYRPPYPYTVTPVGDVKSVVTRYAGVGVIQP

SEQ ID NO: 2291 - DNA, 1238 bp, BACILLUS SP. P-4-N
atattttacattaaatacattctggaaagaggtcgataaaatggtagaaatgaaaaaaatagtttcttacttatttatttttgtcctcatgttaggcaccgcgcctaatgctgcaagcgctaactcttattcctttaagagtacaactggttgggcttctataaatgccgatggagttaatggaacaacaggtggttcaggtgggacggaagtgacagtgacaaatgcagcagatttagaaagatatgcaacggcaaacggcaaatacattattaaagtctcaggttccatcaatctctctccaaaagggaaatacattgacgtcagctccaataaaacaatcgtaggccttaacgcaagctctgaaattataaatggtgggcttaaaataagaggcagtaatgtcatcgttaaaaacctgacgattcgaggcacgtatgtcgagggtgactgggatggcaaaacgaacgattatgatggcattcagatcacgggaaaagacgctcatcatatatggattgatcatgtcacgatgagaaagcatggcgacggattgatagatatcgtaaacggcgctaattatgtgaccatttcaaacagtagatttgagcagcataataaatcgataacaatcagtggcaatgataatgatacgaatacggataaatataaagtcacgattcaagattgctggtttagaggaacaactcaacgaaatccaagagtcagattcggaatggttcacctctataacaactactatagtgatatggggaaatacggaagagatatgggctattcatcctctttaggatatgcgattggtgttggcgtttcagctaaaatatactctgagaataactatttcgaaaacctcagacatcctactagttttatcgatactacaagcaaaccaggatatattagagatagcggtagttattttgtcaatagtgggtctatgacaacgagagcatccggagtcacttggaagccgtctgactactattcatatactttaaggaacgcttctcaagtaagaagccatgtcataaacaatgctggagcaggtaagtaagtacaagtcctagagtacaataacgttcattgaaggcgagtgctaccctctaaaacaaaggaggaggaaaattcatcctcttcctttactatttctaacgacctgaacgaatcctttagtttggccgtttcactgaaaaatgcatgatcgagatccttac

SEQ ID NO: 2292 - protein, 345 aa, BACILLUS SP. P-4-N
MVEMKKIVSYLFIFVLMLGTAPNAASANSYSFKSTTGWASINADGVNGTTGGSGGTEVTVTNAADLERYATANGKYIIKVSGSINLSPKGKYIDVSSNKTIVGLNASSEIINGGLKIRGSNVIVKNLTIRGTYVEGDWDGKTNDYDGIQITGKDAHHIWIDHVTMRKHGDGLIDIVNGANYVTISNSRFEQHNKSITISGNDNDTNTDKYKVTIQDCWFRGTTQRNPRVRFGMVHLYNNYYSDMGKYGRDMGYSSSLGYAIGVGVSAKIYSENNYFENLRHPTSFIDTTSKPGYIRDSGSYFVNSGSMTTRASGVTWKPSDYYSYTLRNASQVRSHVINNAGAGK

SEQ ID NO: 2293 - DNA, 2646 bp, FUSARIUM SOLANI
tctagactcattatccgtaaagacattagataacagcttgctcacgtattctcccttacgagatcctgccgtactcatcatttgcatggactctacctgtaacactagcctctctcctttatcacttgagacggccatgttattatatgatcagctacctcaaacaaccgtgatttttagcttactctctagcacctcgtctaggaataaccataacggtaaccatgatccggcgacccggggtgggttgtcgccaccggacatgggaccatctcggacgggccgaccccataacaaagggactgtaaggcgtggatctcgggacatgatccatgaacggcaaggtgcagcactcggaagaaatccaggggtcggttccgtgatgttgctacgctggactgggcgaactaccgaaagtaagggtcccgagccattcccatggggcgtgtctgcttgttaaccgtattttgaagcatctgacttaaggttaatacgaggttgtaaagccccagtatgtttctaggactatcctagaataagatgtaagaatgaaaaggggcaggcagtcagtagtagatgttgaaggctgcgcttgttgaacgggagtatgccaagcaaatccggtagatcgagtaatacgtcgatcagggtaccagacggattttactccccgtctccgtgatctatactgctgttggttctaaaaactcggcaaacattcataaggctgaacccatcgcccggctccatctcgcctgtccttgccagtcagtgccggccaatggagctctgtggacatgaatagccctgctgcagcagtgacagttgttctacatgcctcacggcttgaccgactcggtttcgctccagctcatccttgcaacggcggaataattcctccattggggaggtggccttctggaataggaccatgtaacagtattttgggtggcaaggtgtcagaatcgccccgaataggtacacacaccttgacagttcggcgacgtagtgattctccggggattgcatgtcactccggcactacaccgccaaggacctggaagcatccggctcctcggcgtttgtcgagtagtgaaacaccgagaagcggtccaatctatcatcccaacctcgaggaacaccaggtataaaagggtagccaagtcctcccctaaacaactccttcattccatcaccatcacgcactcaatcaaacaccactcagctcaactctcaagctcaactcaatcaccatgaaggcctccgctctcatcatcgccgccgtcactggcgcctctgctgccgtcactaccgttcttcccgcttccgccggtgtccagagcgaacccactgccatccccgttcgcaagggagacaagtacaatggtggcatgaagcgattcgtgcgcaaccgtaagtcaacccggaaacaacagtctgactgtcataacaacctcggctgctaacatccatttccgcctttagccaccacttgcaaggaccagtatgagactggtgagaaggacgcctccttcattctcgaggacggtgccactctctccaacgtcatcatcgaccgctcttccggtgagggtgttcactgcaagggcacttggtaagtcactatctcactagcctctacaccacaactaacacatccatcagcaccctgaacaacgtctggtgggccgatgtctgcgaggacgccgccaccttcaaacagaagtctggtacctccaccatcaacggtggtggtgccttcagcgcccaggacaaggtcctccagttcaacggccgcggcactctgaacgtcaacgacttctacgtccaggattacggcaagctggtccgcaactgcggcaactgcgagggcaacggcggcccccggaacatcaacatcaagggcgttgtcgccaagaacggtggcgagctctgcggcgtcaaccacaactacggcgatgtctgcaccatcaccgactcttgccagaacaagggcaagagctgccaggcctacactggtaacgaccagaagaaggagccccccaagttcggccccgctggcgacaacggcaagtcttgcctcgtcaagagcctccgcaccaactgctagatggcttcgctagctttgccaggcggtgatgaatctcgccttcaggggaggcttcttcacgagggagagaccagtcactgattgatgattgtgtgtgttatcttaaagttgtcacttctatgggatctagctggatcgggagctagagagggaaaaagagcataggagtgatagttcttgtgtgtacatatttagacagatagtatataaaatgtgggtttcgatggaacgtcttggccgcttgggtctttcaattacccatttaactgtgaaacctgtcattggagcataggaacaaagccttcagtcttctggctcagttatcccatcaagggccaggcttcaactagagtaaagaacacaatatcgacacatcatagcatcatatcccaatgcttaaacagtggccttttgtttagtcttttagctgcctacagttaaagactcataccaaggtgggaatacatacttcaaagaggctctaggctcaccgacctgacaacatcctgtcataccctgtcgcgacatgtgtcgac

SEQ ID NO: 2294 - protein, 244 aa, FUSARIUM SOLANI
MKASALIIAAVTGASAAVTTVLPASAGVQSEPTAIPVRKGDKYNGGMKRFVRNPTTCKDQYETGEKDASFILEDGATLSNVIIDRSSGEGVHCKGTCTLNNVWWADVCEDAATFKQKSGTSTINGGGAFSAQDKVLQFNGRGTLNVNDFYVQDYGKLVRNCGNCEGNGGPRNINIKGVVAKNGGELCGVNHNYGDVCTITDSCQNKGKSCQAYTGNDQKKEPPKFGPAGDNGKSCLVKSLRTNC

SEQ ID NO: 2295 - DNA, 1332 bp, FUSARIUM SOLANI
aggcctatataagagccattactgcgatcattttgtttctaaaccacctcacttacaagtccatcgtctacagctctctgcttgatctcgacctttacaatcccatcactatccaacatgaaggcttcaattcttcgtgtcgcggccacgagcctgctcccctcgccatggcctgcctcggatacactggtggtgtccccaagcccaccgatcacatctccaacagcaaagtcatcgaggtcaaggcaggccaagtctatgacggcaagtgggccaagtatgatcgtggatccggagcttgcaagggccagaatgagggtggtaagtgaacatacacactcatcgacaagatatatgtgaggttaatatgcttctaggtgacaaggatgccgtgttcctgctccatgagggcgctactctgaagaatgtcatcattggcaaggaccaatctgagggtgttcactgcaagggacactgcactctcgagtttgtctggttcgaagatgtctgcgaggatgccatttccattgtaagtctaccgtcagcaaagatagccttatggattctaacaacctcctagaaggaagacaaggccggcaaggaatcctggatcattggcggaggcgcctaccacgcctcagacaaggtagtccagcacaacggctgcggcaccgtcaacatcatcaacttctacgtcgaggactacggcaagctataccgatcctgcggcaactgcagtaagcagtgcaagcgcaacgtctacattgagggcgtcacggccaagaacggcggcgagctcgcgggcatcaacgccaactacggcgacactgccactctcaagaacgtctgtgccgacgccaagcagaaatgcaccatgtacaatggttgtgctggtggctgtgagcccaagaagattggagcttgtcctgcttaagcggtttgttgatgaaagagatgcattgggctagtttgggcttggtgtgtctttttgttcttgtatataggcttgttcggtgcttggagcttagattgaagtttctaagcaagcagaaatggattttacttgactagaatttgcttgatattgactgtctttgacatacgtagctaacaaagcccccttaactcttaaactgccccctttgctatcccgaagctgggcatgagccatataatcatctgcggcaggtagaagatgaattgaatggtgtgatatgataacttttctttgtgcttggcaaacttacactacgatatggtcccaccgcaaagcaatcactggccatttcatcactcaacatatttcatttgcgcttgtcagctaggcaagct

SEQ ID NO: 2296 - protein, 215 aa, FUSARIUM SOLANI
MACLGYTGGVPKPTDHISNSKVIEVKAGQVYDGKWAKYDRGSGACKGQNEGGDKDAVFLLHEGATLKNVIIGKDQSEGVHCKGHCTLEFVWFEDVCEDAISIAGKESWIIGGGAYHASDKVVQHNGCGTVNIINFYVEDYGKLYRSCGNCSKQCKRNVYIEGVTAKNGGELAGINANYGDTATLKNVCADAKQKCTMYNGCAGGCEPKKIGACPA

SEQ ID NO: 2297 - DNA, 1419 bp, FUSARIUM SOLANI
aagcttatttctcactctagtggtggaaatactgtcccggggatcctcacagagtaaaccagaaacacggccgtgccacgagttcttccgccgtgtcccttcgccgagactggagattgctgcggagcaaaggcccgccgggaggaccgataggcaccggacacgatggctgaacgaggagccatcgtgcgataccgacagtccggaggctcgatataaagatgtgtgaatgtcgcctcgatagcttttgattcagcactcaactcaacgcactctcatcaatccattcacttgcctgcttcttcaaccactcaaccaacaacctcatctcttctacaaccgccaacatgcacgctcccagcatcgtcactgtcctcgccgccctccccgcggccatggcttgcctcggctacaccggtggtgttcccaaggctactggcagcaagtctctgagcgcccccaagaccctcaagaagggtgaggttttcgatgccggctgggtccggtacgaccgtggtgtgaagtgctctggtcaggctgagggtggtaagttgtcacttctctgaaaacttcaagcagcaggttctaattccacttctaggttccaaggacgccgtcttcatcctcgaggagggtgccactctccgcaacgtcatcatcggtgccaaccagcgtgagggtatccactgcaagggctcctgcaacatcgagttcgcctggttcgaggatgtctgcgaggatgccatctccatccttggcagcggcactgccaacatcatcggtggtggtgcttaccacgcctccgacaaggtcatccagcacaacggttgcggtcacgtcaacattgtcaacttctacgccaacgactacggcaaggtctaccgatcttgcggtaactgcaagggcaacaccaactgcaagcgctccgtgcacatggagggcaccaccgccgtcaagggtggtgagctcattggcatcaacaccaactacggtgacaaggccacctactccaacaactgctaccccaagacccagtgccagggttacaagggctgcgacaagtccaagggcgagtgcgagccctccaaggccgccaagtgctaaatggctcgttgacgggcagtgcgctttgagttgttcgttttaattcttctttgataccgttgccggcatctatgtatctgtttatacactatagagtggtggatcgctacctgtacatattaccttagcgaagtacataaaaagagttgagcaggcttggtcctgcgtgtgtctaagattgtttcactcgatattgcaatgtggcccagcttataattgttcttgttccactgggatgaatggcgactcgacttagagctctcatcgccccccccttccgtgctattgactcccctctacttgtaataacgggat

SEQ ID NO: 2298 - protein, 233 aa, FUSARIUM SOLANI
MHAPSIVTVLAALPAAMACLGYTGGVPKATGSKSLSAPKTLKKGEVFDAGWVRYDRGVKCSGQAEGGSKDAVFILEEGATLRNVIIGANQREGIHCKGSCNIEFAWFEDVCEDAISILGSGTANIIGGGAYHASDKVIQHNGCGHVNIVNFYANDYGKVYRSCGNCKGNTNCKRSVHMEGTTAVKGGELIGINTNYGDKATYSNNCYPKTQCQGYKGCDKSKGECEPSKAAKC

SEQ ID NO: 2299 - DNA, 883 bp, FUSARIUM SOLANI PISI
caatcatcatcatgaagttcactgctgctttcgtcgctgccctcgttggcaccagctctgctgccgtcaccaagactctccccaagagtgctggtgctacttccttccccactgccgttcctgtcaagggcagctacgatggtggcatgaagcgattcgagcgagagcccaaagtctgcaagggtcaggatgagactggtgagaaggatgccatgttcattcttgagaatggtgccaccctctccaacgttatcattggtgcttcccaggccgagggtgttcactgcaagggaacttgcactctcaacaatgtctggtgggccgatgtctgtgaggatgctgtcactctcaagcagaccagcggaacctcttacatcaacggtggtggtgctttccacgcctctgacaagatcattcagttcaacggccgcggaaccgtccacgtcaaggacttctacgccgaggactacggaaagctctcccgcagctgcggaaactgcaaggacaacggtggcccccgcaacgtcatcgtcgagaactctgtcgccgtcgatggcggtgtcctctgcggcatcaacaccaactacggcgacacctgcaaggtcatcaactcttgccaggacaagggcaagtactgcgaccgctacgagggcaactctagcggcaaggagcctaccaagattggctctggccctgatggcaagtactgcactgttactggctccaccacgagctgctaagcacgtgcgcttgatgggagatgagatgagatgatgattatcttcttgttacgatatttgatgaaattcggtttctcgagtttagcaactagcatttagctgcactgatgtgatattgcatgtgaataaaacaagtgctatag

SEQ ID NO: 2300 - protein, 242 aa, FUSARIUM SOLANI PISI
MKFTAAFVAALVGTSSAAVTKTLPKSAGATSFPTAVPVKGSYDGGMKRFEREPKVCKGQDETGEKDAMFILENGATLSNVIIGASQAEGVHCKGTCTLNNVWWADVCEDAVTLKQTSGTSYINGGGAFHASDKIIQFNGRGTVHVKDFYAEDYGKLSRSCGNCKDNGGPRNVIVENSVAVDGGVLCGINTNYGDTCKVINSCQDKGKYCDRYEGNSSGKEPTKIGSGPDGKYCTVTGSTTSC

SEQ ID NO: 2301 - DNA, 1338 bp, Clostridium cellulovorans
atggaaaagctaagatttcccaaagattttatttttggaacagccactgcagcatatcaaattgaaggagcttacaaagaagatgagaaaggtgaatctatttgggataggtttagtcatataccaggaaatgtagctaaaatgcataatggtgatattgcttgtgatcactatcatagatataaagaagatgttcagctattaaaaagccttggaattaaaagttataggttttcaattgcttggcctagaattttcccaaaaggttttggcgagataaaccagaagggaattcagttctatagggatttaattgatgaactaattaaaaatgatatagaaccagctataacaatttatcattgggatcttccacaaaagcttcaggatattggagggtgggcaaatccgcaagttgctgattactatgttgattatgcaaacttattattcagagagttcggagatagagtaaaaacatggataactcataatgagccatgggttgcatcatatcttggctatgctttaggagttcatgctccaggaattaaagatatgaaaatggcattgttagctgcacataacatattattatcgcactttaaggcagttaaagcttatagagaattagaacaagatgggcaaataggtataacattaaatctttcaacctgttattcaaattcagctgatgaagaagatattgctgcagcccatagaagtgatggatggaacaacagatggtttttagatgctgcattaaaaggaacttatcctgaggatatgataaaaatctttagcgatacaaatattatgcctgaactacctaaagagttatttactgaggtatttgaaacttctgattttttaggaataaattattatacacgacaagttgtaaagaataactctgaagcttttatcggtgctgaaagtgtagcaatggataatcctaaaacagaaatgggttgggagatatatccgcaagggctttatgatttgctaacgaggatacacagggattatgggaacatagatttatacataacagaaaacggtgcagcttttaatgatatggttaatagagacggtaaagttgaagatgaaaatagattagattatttatacactcattttgctgctgcattaagtgctatagaagcgggagtacctttaaagggatattatatttggtctttcatggataattttgagtgggctgaaggatatgaaaaaagatttggaatagtacatgtaaactataaaactcaggagagaacaataaagaagagtgcttattggtataaggagcttatagaaagatctaataagtaa

SEQ ID NO: 2302 - protein, 445 aa, Clostridium cellulovorans
MEKLRFPKDFIFGTATAAYQIEGAYKEDEKGESIWDRFSHIPGNVAKMHNGDIACDHYHRYKEDVQLLKSLGIKSYRFSIAWPRIFPKGFGEINQKGIQFYRDLIDELIKNDIEPAITIYHWDLPQKLQDIGGWANPQVADYYVDYANLLFREFGDRVKTWITHNEPWVASYLGYALGVHAPGIKDMKMALLAAHNILLSHFKAVKAYRELEQDGQIGITLNLSTCYSNSADEEDIAAAHRSDGWNNRWFLDAALKGTYPEDMIKIFSDTNIMPELPKELFTEVFETSDFLGINYYTRQVVKNNSEAFIGAESVAMDNPKTEMGWEIYPQGLYDLLTRIHRDYGNIDLYITENGAAFNDMVNRDGKVEDENRLDYLYTHFAAALSAIEAGVPLKGYYIWSFMDNFEWAEGYEKRFGIVHVNYKTQERTIKKSAYWYKELIERSNK

SEQ ID NO: 2303 - protein, 473 aa, thermobispora bispora
MTESAMTSRAGRGRGADLVAAVVQGHAAASDAAGDLSFPDGFIWGAATAAYQIEGAWREDGRGLWDVFSHTPGKVASGHTGDIACDHYHRYADDVRLMAGLGDRVYRFSVAWPRIVPDGSGPVNPAGLDFYDRLVDELLGHGITPYPTLYHWDLPQTLEDRGGWAARDTAYRFAEYALAVHRRLGDRVRCWITLNEPWVAAFLATHRGAPGAADVPRFRAVHHLLLGHGLGLRLRSAGAGQLGLTLSLSPVIEARPGVRGGGRRVDALANRQFLDPALRGRYPEEVLKIMAGHARLGHPGRDLETIHQPVDLLGVNYYSHVRLAAEGEPANRLPGSEGIRFERPTAVTAWPGDRPDGLRTLLLRLSRDYPGVGLIITENGAAFDDRADGDRVHDPERIRYLTATLRAVHDAIMAGADLRGYFVWSVLDNFEWAYGYHKRGIVYVDYTTMRRIPRESALWYRDVVRRNGLRNGE

SEQ ID NO: 2304 - DNA, 1422 bp, thermobispora bispora
atgaccgaatcggccatgacatcacgggcgggccgaggacgcggggccgacctcgtggccgcggtcgtccagggacacgcggcggcgagcgacgccgccggggacctgtctttccctgacggcttcatctggggggccgccaccgccgcctaccagatcgagggcgcctggcgagaggacggtcgcgggctctgggacgtcttctcccacaccccggggaaggtggcgagcggccacaccggggacatcgcctgcgaccactaccaccggtacgcggacgacgtgcggctcatggccggcctcggcgaccgcgtgtaccggttctccgtggcctggccccggatcgtcccggacgggtcgggcccggtcaacccggccggcctggacttctacgaccggctcgtggacgagctgctcgggcacggcatcacgccgtaccccaccctctaccactgggacctgccgcagaccctggaggaccggggcggctgggcggcgcgcgacaccgcgtaccggttcgccgagtacgcgctcgccgtccaccggcggctcggcgaccgggtccggtgctggatcacgctgaacgagccgtgggtggcggccttcctcgctacgcaccggggagcacccggggcggccgacgtgccgcgcttccgcgccgtgcaccacctgctgctcggtcacggcctcggcctccgcctgcgctcggcgggcgccggccagcttggcctcacgctcagcctctccccggtgatcgaggcccgccccggggtccggggaggcggccgccgggtggacgcgctcgccaaccggcagttcctcgacccggcgctgcgcggccgctacccggaggaggtcctcaagatcatggccgggcacgcgcggctcggccatccgggacgggacctggagacgatccaccagccggtggacctgctcggggtgaactactactcccacgtacgtctcgcggccgagggcgagccggcgaaccggcttcccgggagcgagggcatccggttcgagcgtccgacggcggtgacggcatggcctggcgatcgacccgacgggctgcgcaccctgctgctgcggctctcccgcgactacccgggagtcggcctgatcatcaccgagaacggggccgcgttcgacgaccgggcggacggcgaccgggtgcacgacccggagcgcatccgctacctcacggccaccctgcgggccgtccacgatgcgatcatggccggtgccgatctgcgcgggtatttcgtatggtcggtgctggacaacttcgagtgggcttacggttaccacaagcgcggcatcgtgtacgtggactacacgaccatgcggcgcatacccagggagagcgcgctgtggtatcgggacgtcgtgcggcgcaatggtctgcggaacggcgagtga

SEQ ID NO: 2305 - DNA, 1353 bp, Thermoanaerobacter brockii
gtgataaaattggcaaaatttccaagagatttcgtttgggggacagccacatcatcataccaaatagaaggagcggtaaatgaagacggaaggaccccttccatatgggacacattttcaaaaacagaagggaagacctataaaggccatacaggagatgtagcctgtgaccattaccaccgctataaagaagatgtagagatattaaaagaaataggagtaaaagcttacagattttcaattgcatggccaagaattttccctgaggaagggaaatacaatccaaaagggatggacttttacaagaagttaatagatgaattacagaaaagagatatagtaccagctgcaacaatttatcactgggatttaccccaatgggcttatgacaaaggaggaggctggctaaatagggaaagtataaaatggtatgtagaatacgccacgaaactatttgaagaattaggcgatgcgatacccctatggataactcataatgagccatggtgttcctcaatattaagctatggaataggagaacatgcgccagggcacaaaaactacagagaggcactaatagcagctcatcatatactactttcccatggagaagcagtaaaagcctttagagaaatgaatataaaagggagtaagattggtataacactaaacttaacccctgcatatccagccagcgaaaaagaagaagacaaattagcagcccaatatgctgacggatttgctaacagatggtttttagatccaatattcaaaggcaattatccagaggatatgatggaattatatagtaaaataattggagaatttgactttataaaagaaggagatttagagactataagtgttccgatagattttcttggagtcaattattatacaagaagtattgtaaaatatgatgaagattccatgctaaaggcagagaatgtgccggggccaggtaagaggacggagatgggatgggagataagcccagagtctttgtatgaccttttaaaaaggctagatagagaatatacaaaactgcctatgtatatcacagagaatggagcagcatttaaagatgaagtgacagaggatggacgagtacacgacgatgaaagaatagaatacattaaagagcacttaaaagcagcagcaaaatttataggagaaggaggtaacttaaaaggatatttcgtatggtcgctgatggacaattttgaatgggcccatggatattcaaaaagatttgggatagtttatgtggattatactacacaaaagagaatattaaaagacagtgcattatggtataaagaggtaatattggatgatggtatcgaagattga

SEQ ID NO: 2306 - DNA, 2264 bp, Thermotoga maritime
gaattcctggctcacggggactgctgcttggagctttgtggcgatcactcagcatatactcgggataaggcctacttacgacagcctggtagtggatccctgcatcccgaaagaatgggaaggattcaggatcacaagaaagttcagaggaagcatctacgatataacggtgaagaatccctctcatgtttccaaaggtgtgaaagagatcattgttgacgggaaaaagatagaagggcaagtacttccggttttcgaggatggaaaggtgcacagggttgaagttgtgatgggctgaccttttgttctccgatgatatagtacagacgagggggtattccccctcttttttttgtggggagagttttgatagaatagttaggcacacgaatcaaaacaacaggagaggtgatgaacgtgaaaaagttccctgaaggattcctctggggtgttgcaacagcttcctaccagatcgagggttctcccctcgcagacggagctggtatgtctatctggcacaccttctcccatactcctggaaatgtaaagaacggtgacacgggagatgtggcctgcgaccactacaacagatggaaagaggacattgaaatcatagagaaactcggagtaaaggcttacagattttcaatcagctggccaagaatacttccggaaggaacaggaagggtgaatcagaaaggactggatttttacaacaggatcatagacaccctgctggaaaaaggtatcacaccctttgtgaccatctatcactgggatcttcccttcgctcttcagctgaaaggaggatgggcgaacagagaaatagcggattggttcgcagaatactcaagggttctctttgaaaatttcggtgatcgtgtgaagaactggatcaccttgaacgaaccgtgggttgttgccatagtggggcatctgtacggagtccacgctcctggaatgagagatatttacgtggctttccgagctgttcacaatctcttgagggcacacgccagagcggtgaaagtgttcagggaaaccgtgaaagatggaaagatcggaatagttttcaacaatggatatttcgaacctgcgagtgaaaaagaagaagacatcagagcggtgagattcatgcatcagttcaacaactatcctctctttctcaatccgatctacagaggagattacccggagctcgttctggaatttgccagagagtatctaccggagaattacaaagatgacatgtccgagatacaggaaaagatcgactttgttggattgaactattactccggtcatttggtgaagttcgatccagatgcaccagctaaggtctctttcgttgaaagggatcttccaaaaacagccatgggatgggagatcgttccagaaggaatctactggatcctgaagaaggtgaaagaagaatacaacccaccagaggtttacatcacagagaatggggctgcttttgacgacgtagttagtgaagatggaagagttcacgatcaaaacagaatcgattatttgaaggcccacattggtcaggcatggaaggccatacaggagggagtgccgcttaaaggttacttcgtctggtcgctcctcgacaatttcgaatgggcagagggatattccaagagatttggtattgtgtatgtagactacagcactcaaaaacgcatcgtaaaagacagtgggtactggtactcgaatgtggttaaaaacaacggtctggaagactgaaaagggcggcctggccgccctttctttttgatacctcgttttctcccctattcgttcactccgcgtgaatatccccgattattttcatttaacgaaaaaaatctcccgttttctcctgataactcacttgcaaagaatttaaaagtctggcaaaatatcaaataggttaatttgattacaacgtcatttaactgatacttaaggaggtgcttttgccatgaagaagtactttgtcctgttgctagcagttcttctggttggtggactcttcgctgtgaaaatcactatgacatctggaggggtcggaaaggaactcgaggtactgaaaaagcagctggagatgttccaccagcagtacccagatatcgaagtggaaatcattccgatgccggacagttcaactgaaaggcacgatctctacgtcacgtactttgccgccggagagacggatccagacgttctcatgctcgatgtgatatggcctgctgagtttgctccgttccttgaagatc

SEQ ID NO: 2307 - protein, 446 aa, Thermotoga maritime
MNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 2308 - DNA, 2177 bp, Thermus caldophilus
ggatcctcaggggcttcttcgcctctattcctaaagagcttgaggaggcggccatggtggacggggccacgcccttccaggccttccaccgggtgatcctgcccctggccctcccgggcctcgcggccacggccgtctacatcttcctcaccgcctgggacgagctcctcttcgcccaggtcctcaccaccgaggccaccgccaccattcccgtgggcatccgcaacttcgtgggcaactaccaaaaccgctacgacctggtcatggccgccgccacggtggccacgctgcccgtcctcgtcctcttcttcttcgcgcagcgccagctcatccaaggcctcaccgccggggcggtgaagggctaggttcttggaggagaaacgcctatgaccgagaacgccgaaaagtttctgtggggggtagccaccagcgcctaccagattgagggggccacccaggaggacgggcgggggccttccatctgggacaccttcgcccgccgccccggggccatccgggacggaagcacaggggagcccgcctgcgaccactaccaccgctacgaggaggacatcgcccttatgcaatccctcggggtgggggtctatcgcttctccgtggcctggccccggatcctccccgagggccgggggcggatcaaccccaagggcctcgccttttacgaccgcctggtggaccggcttctcgcggcggggatcacgcccttcctcaccctctaccactgggacctgccccaggccctcgaggaccggggcggctggcggagccgggagaccgccttcgccttcgccgagtacgccgaggcggtggcccggaccctcgccgaccgggtgcccttcttcgccaccctgaacgagccctggtgctcggccttcctcgggcactggacgggggaacacgcccccggcctcaggaacctggaggcggcccttcgcgccgcccaccacctcctcctggggcacggcctcgccgtggaggccttgagggccgcgggggcgaagcgggtggggatcgtcctcaacttcgccccggcctacggcgaggaccccgaggcggtggacgtggccgaccgctaccacaaccgctacttcctggaccccatcctgggcagggggtatcccgaaagcccctttcaagaccccccgcccactcccatcctctcccgtgacctggagctcgtcgcaaggcccctggacttcctaggagtgaactactacgcccccgtccgcgtggccccggggacggggcctttgcccgtgcgctaccttcccccggaggggccggtcacggccatggggtgggaggtctaccccgaggggctttaccacctcttgaagcgcctcggccgggaggtgccctggcccctttacatcacggaaaacggggccgcctaccccgacctctggacgggagaggccgtcgtggaggaccccgagcgggtggcctacctcgaggcccacgtggaggccgccctccgggcccgggaagaaggggtggacctcaggggctacttcgtctggagcctcatggacaactttgagtgggccttcggctacacccggcgcttcggcctctactacgtggacttccccagccagaggcgcatccccaaaaggagcgccctctggtaccgggagcggatcgcgcgggcccagctctgagcgtccgcgcattgatcccgccacttagggcccccgaaccggggagggtggacggcgaggactccagaggcctccaccctccccataagggcctcgaggtcccgggaagaggtcctaaaactcaaagaaggccgggacgaaggcgtacctccccttcccgccggatgtacccaacggcgggccaggggaagtggtaggcggtgatcaggctccgctcctccgagaccttctggaagaggcgggcccgggtccgcaccacctgcgccttgtccatgtcaaagcccaggtaggcctggggaaagcggagggagaggaggtagtggcccgccgcatccccaaaatgaagagcctctttccctcggaggtggcctcgaggctcatgtgccccggggtgtggccgaaggaggccaccgcccgcacccccgggaccatctcctccccgtcctccacgggccggatgcgctccttaaggggcacgagggccctttgcaccgc

SEQ ID NO: 2309 - protein, 431 aa, Thermus caldophilus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARTLADRVPFFATLNEPWCSAFLGHWTGEHAPGLRNLEAALRAAHHLLLGHGLAVEALRAAGAKRVGIVLNFAPAYGEDPEAVDVADRYHNRYFLDPILGRGYPESPFQDPPPTPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 2310 - DNA, 1266 bp, Pyrococcus furiosus
atgccccttaagtttcctgaagagttcctgtttggtactgcaacagcggctcaccaaatagagggagacaacaagtggaatgattggtggtattatgagcagattggcaaactcccctataagtctgggaaggcgtgtaaccattgggaattctataaagaggatatccagctaatggcaagtttggggtacaatgcctatagattctccatagagtggagcagattgttcccagaagagaacaaatttaatgaagaagctttcaatagatatcaagaaattatagacctgcttttagcgaacaacataactcctctagtgactctccatcactttactagtccgctctggttcatgaagaaaggaggctttcttagagaggagaacttaaagttctgggaaaagtatgtggaaaaggttgcagagctcttagaaaaagtaaaattgatagcaacattcaacgagccaatggtatatgtgatgatgggttatctaactgcctattggcctcccttcatcaaaagtccctttaaagcctttaaagtcgcttcaaacttgctcaaagctcatgcgcttgcatatgaaattcttcatgggaagtttcaagtaggaatagtgaaaaacgttccaataatgctcccagctactgacaaagagagggacaaaaaagccgctgagagagctgataatttgttcaattggtacttcttggatgcaatttggagtggggtgtacaggggagcattcaaggcttatagggttccacaaagcgacgcagacttcattgggataaattattatacagcaagtgaagtgaggcatagctggaatccgctaaagtttttctttgacgcgaaattggcggatgttagtgagagaaagacccagatgggatggagtgtttatcccaggggaatatacatagctctaaaaaaggcctctaagtatggaaaaccactatacattaccgagaacggaatagcaacgctagatgatgagtggagaatagagttcataatccaacatctccaatacgttcataaggccattgaagatggcttggatgtaagaggctacttctattggtcatttatggacaactatgaatggagagaaggctttgaacctaggtttgggttggtggaagtggattatgagacctttgaaagaaggcctaggaagagtgcctacatatatggggggattgcaaaaagtaaggaaataaaagatgaaatattggaaaaatatggattgtcaagtctttga

SEQ ID NO: 2311 - protein, 421 aa, Pyrococcus furiosus
MPLKFPEEFLFGTATAAHQIEGDNKWNDWWYYEQIGKLPYKSGKACNHWEFYKEDIQLMASLGYNAYRFSIEWSRLFPEENKFNEEAFNRYQEIIDLLLANNITPLVTLHHFTSPLWFMKKGGFLREENLKFWEKYVEKVAELLEKVKLIATFNEPMVYVMMGYLTAYWPPFIKSPFKAFKVASNLLKAHALAYEILHGKFQVGIVKNVPIMLPATDKERDKKAAERADNLFNWYFLDAIWSGVYRGAFKAYRVPQSDADFIGINYYTASEVRHSWNPLKFFFDAKLADVSERKTQMGWSVYPRGIYIALKKASKYGKPLYITENGIATLDDEWRIEFIIQHLQYVHKAIEDGLDVRGYFYWSFMDNYEWREGFEPRFGLVEVDYETFERRPRKSAYIYGGIAKSKEIKDEILEKYGLSSL

SEQ ID NO: 2312 - DNA, 2166 bp, Bacillus subtilis; identical to SEQ ID NO: 1720

SEQ ID NO: 2313 - protein, 589 aa, Bacillus subtilis; identical to SEQ ID NO: 1721
